(12) United States Patent
Vives Florez et al.

(10) Patent No.: US 10,576,114 B2
(45) Date of Patent: Mar. 3, 2020

(54) **COMPOSITION COMPRISING BACTERIOPHAGES FOR REDUCING, ELIMINATING AND/OR PREVENTING *SALMONELLA ENTERITIDIS*, *SALMONELLA TYPHIMURIUM* AND *SALMONELLA PARATYPHI* B**

(71) Applicant: UNIVERSIDAD DE LOS ANDES, Bogota (CO)

(72) Inventors: Martha Josefina Vives Florez, Bogota (CO); Ana Paula Jimenez Sanchez, Bogota (CO); Angela Victoria Holguin Moreno, Bogota (CO)

(73) Assignee: UNIVERSIDAD DE LOS ANDES, Bogota (CO)

( * ) Notice: Subject to any disclaimer, the term of this patent is extended or adjusted under 35 U.S.C. 154(b) by 62 days.

(21) Appl. No.: 15/779,371

(22) PCT Filed: Nov. 21, 2016

(86) PCT No.: PCT/IB2016/057014
§ 371 (c)(1),
(2) Date: Aug. 31, 2018

(87) PCT Pub. No.: WO2017/089947
PCT Pub. Date: Jun. 1, 2017

(65) Prior Publication Data
US 2019/0070231 A1 Mar. 7, 2019

(30) Foreign Application Priority Data
Nov. 25, 2015 (CO) .................... 15281747

(51) Int. Cl.
| | |
|---|---|
| A61K 35/76 | (2015.01) |
| C12N 7/00 | (2006.01) |
| A23K 10/18 | (2016.01) |
| A23K 50/75 | (2016.01) |
| A61L 2/00 | (2006.01) |
| A23K 20/153 | (2016.01) |
| A61P 31/04 | (2006.01) |
| A61K 9/12 | (2006.01) |
| A61K 9/70 | (2006.01) |
| A61K 38/16 | (2006.01) |

(52) U.S. Cl.
CPC ............. *A61K 35/76* (2013.01); *A23K 10/18* (2016.05); *A23K 20/153* (2016.05); *A23K 50/75* (2016.05); *A61K 9/12* (2013.01); *A61K 9/7015* (2013.01); *A61K 38/162* (2013.01); *A61L 2/00* (2013.01); *A61P 31/04* (2018.01); *C12N 7/00* (2013.01); *A01K 2227/30* (2013.01); *A23V 2002/00* (2013.01); *C12N 2795/10021* (2013.01); *C12N 2795/10031* (2013.01); *C12N 2795/10032* (2013.01); *C12N 2795/10121* (2013.01); *C12N 2795/10131* (2013.01); *C12N 2795/10132* (2013.01)

(58) Field of Classification Search
None
See application file for complete search history.

(56) References Cited

U.S. PATENT DOCUMENTS

| | | |
|---|---|---|
| 6,322,783 B1 | 11/2001 | Takahashi |
| 2003/0113293 A1 | 6/2003 | Bermudes et al. |
| 2006/0094076 A1 | 5/2006 | Stave et al. |
| 2008/0118468 A1 | 5/2008 | Sulakvelidze et al. |
| 2009/0304638 A1 | 12/2009 | Yoon et al. |
| 2010/0135962 A1 | 6/2010 | Kang et al. |
| 2010/0158870 A1 | 6/2010 | Kang et al. |
| 2011/0052544 A1 | 3/2011 | Shin et al. |
| 2012/0294892 A1 | 11/2012 | Choi et al. |
| 2014/0219968 A1 | 8/2014 | Llagostera et al. |
| 2014/0220659 A1 | 8/2014 | Dastych et al. |

OTHER PUBLICATIONS

Search Report dated Dec. 4, 2017 for Colombian Application No. 15281747.

*Primary Examiner* — Michelle S Horning
(74) *Attorney, Agent, or Firm* — Lucas & Mercanti, LLP

(57) ABSTRACT

The present invention relates to a new cocktail of bacteriophages with specific lytic activity against *Salmonella enteritidis*, *Salmonella typhimurium* and *Salmonella paratyphi* B., for reducing, eliminating and/or preventing them in farm animals and animals from the poultry sector, such as poultry, hens and breeding hens, in addition to eggs. It may be administered as an additive in the feed, in water or by spray. Moreover, the cocktail may be used as a disinfectant in work areas of farms and abattoirs, and in processed foods, without affecting the organoleptic properties of the product.

20 Claims, 2 Drawing Sheets
Specification includes a Sequence Listing.

Figures

COMPOSITION COMPRISING BACTERIOPHAGES FOR REDUCING, ELIMINATING AND/OR PREVENTING *SALMONELLA ENTERITIDIS, SALMONELLA TYPHIMURIUM* AND *SALMONELLA PARATYPHI* B

FIELD OF THE INVENTION

The present invention relates to a new cocktail of bacteriophages with specific lytic activity against *Salmonella enteritidis*, *Salmonella typhimurium* and *Salmonella paratyphi* B., for reducing, eliminating and/or preventing them in farm animals and animals from the poultry sector, such as poultry, hens and breeding hens.

BACKGROUND OF THE INVENTION

*Salmonellosis* is one of the main causes of bacterial gastroenteritis in humans (Brenner, et al. 2000). Each year, 93.8 million cases are reported globally, giving high indices of morbidity and mortality (155 000 deaths/year) (Majowicz, et al. 2010; Cabrera, 2008). In the United States it is estimated that 40% of the infections caused by *Salmonella* occur in children under 10 years (Angulo, et al. 2004). Treatment of this disease imposes a considerable economic burden on many countries; according to the United States Department of Agriculture (USDA), the annual cost for treating *salmonellosis*, including loss of productivity, in 2005 was 2.3 billion dollars (Atterbury, 2007). Usually these pathogens cause mild and moderate gastroenteritis, but in more severe cases they may cause septicemias (Zhao, et al. 2001).

Transmission of *Salmonella* is mainly due to consumption of contaminated foods, in particular by consuming poultry products, which are widely accepted as the main source of infection with this bacterium (Atterbury, 2007).

The USDA estimates that 50-75% of the cases of *salmonellosis* are due to the purchase of contaminated poultry products, in particular through consumption of chicken and eggs. The most prevalent serovars worldwide include *Salmonella enteritidis* (64.5%) and *Salmonella typhimurium* (16.5%) (WO2004071324 A2; EP 2 550 870 A1). However, in 2010 the group for Integrated Investigation and Vigilance of Antimicrobial Resistance—COIPARS of the Colombian Corporation for Agricultural Research—CORPOICA, after reporting a prevalence of *Salmonella* of 41% in chicken-producing farms and 26% in chicken at points of sale, found that the serovars of *Salmonella paratyphi* B and *Salmonella Heidelberg* were the most prevalent in farms in Colombia (Donado-Godoy, et al. 2012). Regarding *Salmonella paratyphi* B, there was a prevalence in farms of 76% and in meat at points of sale of 51%, whereas *Salmonella Heidelberg* had a prevalence of 23% and 16%, respectively (Donado-Godoy, 2010). This report was of great importance in the sector since it was the first time that *Salmonella paratyphi* B had been reported in the food chain of the poultry sector. Based on this publication, a study was conducted in which isolates of *Salmonella* were serotyped at various points of the poultry chain, including workers in the sector. As a result, the serotypes isolated from farms and abattoirs were exactly the same as found in humans, company workers (personal communication). The earlier study shows that the increase in serotypes isolated as *Salmonella paratyphi* B are reaching humans and therefore may be generating new outbreaks of a pathogenic *Salmonella* that was not being controlled and that may become a new public health problem.

One of the reasons why there is a high prevalence of *Salmonella* in foods of poultry origin is due to their capacity for colonizing the intestine of chicken; in the case of *Salmonella enteritidis*, *Salmonella typhimurium* and *Salmonella paratyphi* B, they do not produce infection or visible symptoms in the bird and they have the capacity to colonize the interior of eggs. However, they cause disease in humans who consume contaminated poultry products because *Salmonella* crosses the intestinal barrier, destroying the microvilli of the epithelial cells and in consequence affecting the capacity for absorption (Zhao, 2002; Keller, et al. 1995).

Control of *Salmonella* in the poultry chain has been based historically on a combination of biosafety in the farm, taking appropriate sanitary measures for housing, production and marketing, in addition to the use of antimicrobials and vaccines (Atterbury, 2007). Contamination in poultry farms is the result of infected birds and cross contamination in the production chain (San Myint, 2004; Carrasco, et al. 2012). Cross contamination occurs owing to failure to implement good manufacturing practice, where lack of hygiene, and mistakes in the steps of refrigeration and transport of the products, mean that the conditions of biosafety in the production chain are not the most appropriate (Carrasco, et al. 2012; San Myint, 2004). In any case, the initial source of contamination by *Salmonella* is due to the state of the infected poultry. The importance of the foregoing lies in control of the bacterium from its initial inoculum, so as to reduce contamination by *Salmonella* in the subsequent steps of the production process for poultry-based food products (San Myint, 2004).

The cost of the treatments that are used for reducing *Salmonella* in chicken farms and in foods is high because they are widely distributed pathogens and they colonize easily (Zhao, 2002; WO 2004071324 A2). That is why various treatments have been implemented for controlling and reducing these pathogens such as the use of chlorinated water in sprays, physical treatments such as steam cleaning, dry heat and ultraviolet light, and the use of chemical additives. However, in some cases it has been reported that the organoleptic quality of the final product may be affected (Garcia, et al. 2008). Regarding the use of disinfectants, these have been used for eradicating the pathogens and for reducing cross contamination during the production process, but the appearance of resistance and the environmental consequences mean that it is not fully effective (Goode, et al. 2003). Another treatment widely used throughout the world for controlling *Salmonella* serovars in the poultry industry is vaccination. There are reports that show cases of low efficiency, since the vaccines that are used most are made from inactivated or attenuated reference strains that do not cover all of the serotypes present in all poultry farms (Zhao, 2002; Vandelplas, et al. 2010). Moreover, the vaccines are only directed at controlling *Salmonella enteritidis* and *Salmonella typhimurium*, but not *Salmonella paratyphi* B, a new emerging pathogen in the Colombian poultry sector, and that has previously occurred in several European countries, which makes its control even more difficult (Donado-Godoy, et al. 2012; Van Immersel, et al. 2004).

Antimicrobials have been used in agriculture since the beginning of 1950 for treating bacterial infections and to improve feed efficiency both in the cattle-raising sector and in the poultry sector (Angulo, et al. 2004). In recent years, the overuse of antimicrobials in the poultry industry has resulted in the appearance of *Salmonella* strains that are resistant to these medicinal products (INS, 2011). The problem is that most of them are used for controlling bacteria in animals for human consumption and in hospitalized patients who require clinical treatment. As a result, this increases the probability of zoonotic bacteria developing resistance to the medicinal products used in humans (Angulo, et al. 2004). The emergence of multi-drug resistant (MDR) *Salmonella* strains is of great concern to the medical and veterinary professions, since according to epidemiological studies, the commonest source of MDR strains in humans is due to the consumption of contaminated foods of animal origin (O'Flynn et al., 2006).

Faced with the need for new strategies for controlling, eliminating and/or reducing *Salmonella* in the poultry industry, phage-therapy has become very important in recent years since the results are promising. Bacteriophages are viruses that kill bacteria and they are widely distributed in all types of environments. Their use has proved to be an effective method for controlling zoonotic bacteria, since they have unique advantages compared to the antimicrobials (Atterbury, 2007). The advantages of phage-therapy include specificity, and bacteriophages may be strain-specific or species-specific. This characteristic is of great importance because it avoids the imbalance of the intestinal microbiota, contrary to that frequently caused by broad-spectrum antimicrobials (Atterbury, 2007; Kutter & Sulakvelidze, 2005). Also, the bacteriophages replicate while the bacterium is viable, i.e. when it is eliminated, the phages are naturally self-limiting (Atterbury, 2007). Bacteriophages are not toxic to animals or humans, as they only attack bacteria. On the other hand they have the capacity to increase their initial concentration, so that on infecting bacteria they multiply within them until they are eliminated (Kutter & Sulakvelidze, 2005; Summers, 2001); the advantage obtained from the aforementioned process is reduction of the initial doses necessary for eliminating the bacterial contaminations.

In this connection, various compositions have been reported that comprise specific phages or combinations of phages that are used for controlling bacteria, especially *Salmonella*. One of the cases reported corresponds to patent WO2013024304, which discloses the use of bacteriophages for lysis of the bacterium *Salmonella*. That document discloses compositions that comprise bacteriophages selected from ΦSH17, ΦSH18, ΦSH19 or a variant of one of these bacteriophages, wherein the variant retains the phenotypic characteristics of the parent bacteriophage. Moreover, patents US20090297561, WO2005024005, U.S. Pat. No. 8,293,515, U520080118468, U520130336932, U.S. Pat. Nos. 8,685,696, 8,597,928 and WO2013014273 describe various types of bacteriophages that have specific activity against *Salmonella* and that are used, moreover, for preparing compositions useful for control, and treatment of infection in animals or humans as well as in the colonization of processed and unprocessed food products by *Salmonella*, or colonization of equipment involved in the processing of said food products.

Moreover, patent RU2232808 teaches a biological preparation for treating and preventing *salmonellosis* in farm animals and poultry, wherein said biopreparations contain various strains of bacteriophages, which are used in an effective amount.

In this class of ideas, patent WO2013169102 relates to a bacteriophage, a polypeptide and a corresponding polynucleotide, a nucleic acid molecule and/or vector and/or cell that comprises said polynucleotide, a composition that comprises said bacteriophage, polypeptide, polynucleotide, construct, vector and/or cell, for the prevention, treatment or diagnosis of contamination with *Salmonella*.

Finally, there are also documents such as patent US20140220659, which discloses a method for preparing a strain of bacteriophages specific to a selected bacterial strain, strains of bacteriophages obtained in this way and the use of bacteriophages for preparing a preparation for the prevention and treatment of infections of farm animals, especially poultry, with strains of pathogenic bacteria that are sensitive to these bacteriophages. Moreover, this document provides technology for production of an antimicrobial preparation suitable for use as a feed additive for poultry and pigs, which at the same time is specific to the pathogenic strains of *Salmonella* that cause the occurrence of *salmonellosis*, especially in human beings.

BRIEF DESCRIPTION OF THE INVENTION

The main aim of the present invention is to provide a new cocktail of bacteriophages with bactericidal activity against serovars of *Salmonella enteritidis, Salmonella typhimurium* and *Salmonella paratyphi* B. The cocktail contains bacteriophages resistant to chlorine and stable at ambient conditions and at 4° C. Therefore the new cocktail may be used prophylactically for preventing colonization of the strains of *Salmonella* in farm animals, poultry and eggs.

An additional aim of the invention is to block the cycle of colonization of pathogenic bacteria in farm animals and poultry by reducing and/or eliminating the transmission of bacterial pathogens during the life cycle of farm animals and birds.

Another aim of the invention is to reduce, eliminate or prevent the colonization of eggs by bacterial pathogens such as *Salmonella enteritidis* and *Salmonella typhimurium* and *Salmonella paratyphi* B.

An additional aim of the invention is to minimize or eliminate the strains of *Salmonella enteritidis, Salmonella typhimurium* and *Salmonella paratyphi* B that colonize farm animals, eggs and poultry, by the application of the new cocktail of bacteriophages in the environment of the farm animals, hens, eggs and poultry.

An additional aim of the invention is to prevent and eliminate the strains of *Salmonella enteritidis, Salmonella typhimurium* and *Salmonella paratyphi* B that contaminate plant, equipment and machinery involved in the production process of animals for human consumption, such as chicken and eggs, by using the new cocktail of phages as disinfectant in work areas of farms, on surfaces in abattoirs and in processed foods.

It is an aim of the invention to provide alternatives for improving the health of farm animals and for reducing, eliminating or preventing the mortality thereof.

The present invention provides a collection of bacteriophages that can make up a cocktail of various bacteriophages against *Salmonella enteritidis, Salmonella typhimurium* and *Salmonella paratyphi* B.

To achieve these aims, the present invention is directed at the presentation and/or application of a new cocktail of bacteriophages during the production of poultry and/or eggs for reducing, eliminating or preventing the colonization of bacterial pathogens such as *Salmonella enteritidis, Salmonella typhimurium* and *Salmonella paratyphi* B. The term "production" as applied to poultry includes, but is not limited to reproduction, rearing, storage, processing and handling of poultry and all the associated functions. The term "production" as applied to eggs includes, but is not limited to incubation, storage and processing of eggs for consumption and all the associated functions. The term "poultry" includes, but is not limited to fattening chicken, hens and breeding hens. Bacterial colonization refers to the initial exposure of a pathogen and the initial growth and expansion of the population of the microorganism or microorganisms. After colonization, infection occurs, and the bacterial population alters the homeostasis of the host and produces adverse symptoms.

In view of the foregoing, the subject matter for protection corresponds to a new cocktail of phages that comprises bacteriophages of the order Caudovirales, that have lytic activity against various strains of *Salmonella enteritidis, Salmonella typhimurium* and *Salmonella* paratyphi B. Said cocktail may be used for industrial application, and is administered by means of liquid media such as sprays, buffers or water, and solids such as powder or pellets. Said cocktail comprises phages from a collection of phages characterized and selected for their efficacy and their absence of virulence or toxicity genes.

DETAILED DESCRIPTION OF THE INVENTION

Figure 1:
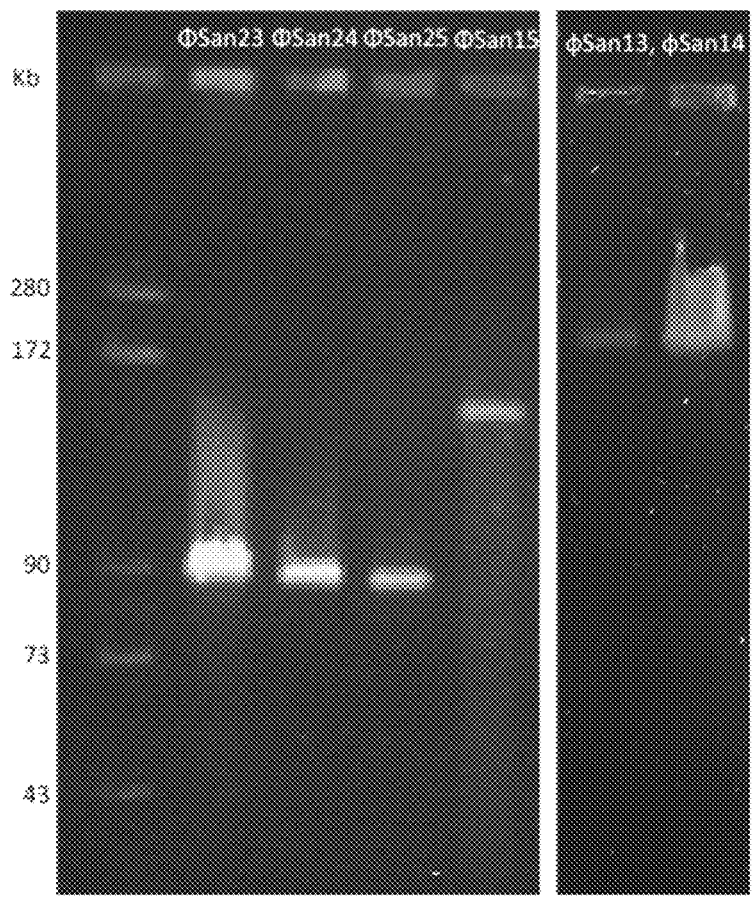
FIG. 1. PFGE of the 6 phages of the invention, φSan13 (SEQ ID NO: 1), φpSan14 (SEQ ID NO: 2), φpSan15 (SEQ ID NO: 3), φpSan23 (SEQ ID NOs: 4 AND 5), φpSan24 (SEQ ID NO: 6) and φpSan25 (SEQ ID NO: 7).

The present invention relates to a new cocktail of bacteriophages with specific lytic activity against *Salmonella enteritidis, Salmonella typhimurium* and *Salmonella paratyphi* B., for reducing, eliminating and/or preventing them in farm animals, poultry and eggs.

The new cocktail is made up of bacteriophages selected from a collection of phages, all belonging to the order Caudovirales.

The present invention discloses compositions of bacteriophages that comprise excipients and 6 phages, designated hereinafter as φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

In addition, the genomes are free from toxicity and virulence genes, which makes them ideal for industrial application as they are safe for animals that consume them and for humans who consume the poultry products.

Tests in vivo demonstrated the harmlessness of the cocktail of phages in farm birds. There were no differences in mortality relative to the control group without phages and there were no sick birds on being exposed to the phages. The safety and harmlessness of the phages of the present invention were thus confirmed.

On the other hand, the cocktail of phages makes it possible to counteract bacterial resistance, in contrast to antibiotics and disinfectants. Based on the foregoing, the phages that make up the cocktail may be replaced with any of the phages in the collection when this is necessary to minimize the risk of development of resistance.

It remains stable at 4° C. for two years and at ambient temperature of 20° C. for 1 month. Stability at pH 7.0 is maintained for one year.

The phages are stable in the chlorinated water that the farm animals drink (chlorine concentration 0.000975%) and they remain viable for 24 h.

The efficiency in vitro of the cocktail of bacteriophages decreases the bacterial population of *Salmonella* between 3.33 and 4.62 log 10 CFU/ml during 10 hours of exposure to the cocktail.

Testing in vivo in poultry showed that administration of the cocktail of phages of the invention increased the weight of the birds by 70 grams relative to the control. Average weight of the control at the end of the production cycle: 2.252±125 g and average weight of the treatment with phages at the end of the production cycle: 2.322±121 g.

Moreover, tests in vivo in poultry showed a difference in the conversion and/or feed efficiency of the birds, with the birds exposed to the phages having a better efficiency than the birds of the control without phages.

A result additional to the tests in vivo was the observation of greater uniformity in the weight of the birds that were administered the cocktail of phages of this invention, than the birds of the control without phages.

The excipients that accompany the cocktail of phages in the composition are selected from a solvent or a buffer. For example, it is a solution consisting of 5.8 g NaCl, 5 ml of 2% gelatin, 50 ml 1M Tris-HCl, pH 7.5, 1.2 g $MgSO_4$ $7H_2O$ (Kutter & Sulakvelidze, 2005).

The size of the genomes of the phages usually varies between 30 and 180 kb. The new cocktail or composition of bacteriophages comprises the phages: φSan13 (SEQ ID NO: 1) with a genome size of 170 kb, φSan14 (SEQ ID NO: 2) with a genome size of 170 kb, φSan15 (SEQ ID NO: 3) with a genome size of 159.3 kb, φSan25 (SEQ ID NO: 7) with a genome size of 86.7 kb, φSan23 (SEQ ID Nos: 4 and 5) with a genome size of 90 kb and φSan24 (SEQ ID NO: 6) with a genome size of 90 kb, and an additional component, such as an excipient that is selected from a solvent or a buffer.

It may be administered by means of liquid media such as sprays, buffers, or water, and solid media such as powder or pellets to be administered in the feed.

One embodiment of the invention is the use of the composition of bacteriophages φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7) for the control of *Salmonella enteritidis, Salmonella typhimurium* and *Salmonella paratyphi* B, on surfaces, plant, equipment and machinery that are present in farms for animals, especially poultry farms.

Another embodiment of the invention is the use of the composition of bacteriophages φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7) for the control and/or elimination of *Salmonella enteritidis, Salmonella typhimurium* and *Salmonella* paratyphi B, in farm animals, poultry, eggs and processed foods and the packaging thereof.

In another embodiment of the invention, the composition of bacteriophages φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), or φSan25 (SEQ ID NO: 7) for the prevention of *Salmonella enteritidis, Salmonella typhimurium* and *Salmonella paratyphi* B, is used in farm animals, poultry, eggs and processed foods and the packaging thereof.

One embodiment of the invention also comprises a composition of bacteriophages φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7) in a dose of $10^7$-$10^9$ PFU/mL.

Moreover, another embodiment of the invention corresponds to a liquid or solid feed supplement that comprises a composition of bacteriophages that comprises between one and six bacteriophages selected from the set φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

Moreover, another embodiment of the invention corresponds to a disinfectant that comprises a composition of bacteriophages that comprises between one and six bacteriophages selected from the set φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

In a preferred embodiment of the invention, the composition of bacteriophages for the prevention, elimination and/or reduction of infections and contaminations caused by *Salmonella enteritidis, Salmonella typhimurium* and *Salmonella paratyphi* B is characterized in that it comprises at least one of the six lytic phages against *Salmonella*, φSan13 (SEQ ID NO: 1), φSan14 (SEQ ID NO: 2), φSan15 (SEQ ID NO: 3), φSan23 (SEQ ID Nos: 4 and 5), φSan24 (SEQ ID NO: 6), or φSan25 (SEQ ID NO: 7); or between 1 and 6 phages selected from the set φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

In another embodiment of the invention, the cocktail of bacteriophages for the prevention, elimination and/or reduction of infections and contaminations caused by *Salmonella enteritidis, Salmonella typhimurium* and *Salmonella paratyphi* B is characterized in that it comprises at least 2 of the 6 lytic phages against *Salmonella*, φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), or φSan25 (SEQ ID NO: 7); or between 2 and 6 phages selected from the set φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

In a different embodiment of the invention, the composition of bacteriophages for the prevention, elimination and/or reduction of infections and contaminations caused by *Salmonella enteritidis, Salmonella typhimurium* and *Salmonella paratyphi* B is characterized in that it comprises at least 3 of the 6 lytic phages against *Salmonella*, φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), or φSan25 (SEQ ID NO: 7); or between 3 and 6 phages selected from the set φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

In a different embodiment of the invention, the composition of bacteriophages for the prevention, elimination and/or reduction of infections and contaminations caused by *Salmonella enteritidis, Salmonella typhimurium* and *Salmonella paratyphi* B is characterized in that it comprises at least 4 of the 6 lytic phages against *Salmonella*, φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), or φSan25 (SEQ ID NO: 7); or between 4 and 6 phages selected from the set φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

Finally, in another preferred embodiment of the invention, the cocktail of bacteriophages for the prevention, elimination and/or reduction of infections and contaminations caused by *Salmonella enteritidis, Salmonella typhimurium* and *Salmonella paratyphi* B is characterized in that it comprises the 6 lytic phages against *Salmonella*, φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), or φSan25 (SEQ ID NO: 7).

Similarly, the present composition of bacteriophages for the prevention, elimination and/or reduction of infections and contaminations may also comprise additional phages selected from the order Caudovirales that have lytic activity against various strains of *Salmonella enteritidis, Salmonella typhimurium* and *Salmonella* paratyphi B.

In one embodiment of the invention, the composition of phages comprises only phages selected from the set φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7).

Additionally, in another embodiment of the invention, said composition is characterized in that each of the phages is in an equal proportion.

Moreover, in another embodiment of the invention, the composition is characterized in that each of the phages is in a different proportion.

Thus, Table 1, presented below, contains the particular characteristics of each of the phages of interest, which allow specific differentiation thereof with respect to all the various types of phages that may occur.

TABLE 1

Characteristics of the bacteriophages against *S. enteritidis, S. typhimurium* and *S. paratyphi* B

| Associated sequence | Name of phage | Genome size (kb) | *Index of infection (0-1) | **Index of efficiency of plating (EOP) (0-1) | Virulence or toxicity genes (yes/no) | Infecting strains of *Salmonella* |
|---|---|---|---|---|---|---|
| SEQ ID Nos: 4 and 5 | φSan23 | 90 | 0.72 (13/18) | 0.92 (12/13) | NO | *S. enteritidis* and *S. typhimurium* |
| SEQ ID NO: 6 | φSan24 | 90 | 0.66 (12/18) | 0.67 (8/12) | NO | *S. enteritidis* and *S. typhimurium* |
| SEQ ID NO: 7 | φSan25 | 86.7 | 0.66 (12/18) | 0.58 (7/12) | NO | *S. enteritidis* and *S. typhimurium* |

TABLE 1-continued

Characteristics of the bacteriophages against *S. enteritidis, S. typhimurium* and *S. paratyphi* B

| Associated sequence | Name of phage | Genome size (kb) | *Index of infection (0-1) | **Index of efficiency of plating (EOP) (0-1) | Virulence or toxicity genes (yes/no) | Infecting strains of *Salmonella* |
|---|---|---|---|---|---|---|
| SEQ ID NO: 3 | φSan15 | 159.3 | 0.78 (14/18) | 0.57 (8/14) | NO | *S. enteritidis* and *S. typhimurium* |
| SEQ ID NO: 1 | φSan13 | 170 | 1 (5/5) | 1 (5/5) | NO | *S. enteritidis, S. typhimurium* and *S. paratyphi* B |
| SEQ ID NO: 2 | φSan14 | 170 | 0.8 (4/5) | 1 (4/4) | NO | *S. enteritidis, S. typhimurium* and *S. paratyphi* B |

*Index of infection: is calculated by dividing the number of strains of *Salmonella* that the phage infects, over the total number of strains evaluated.
**Index of the efficiency of plating (EOP): is calculated by dividing the number of strains of *Salmonella* that the phage infects with EOP ≥ 1, over the number of strains evaluated that the phage infects, without taking the EOP into account. Efficiency of plating (EOP): is the ratio of the titer of the phage in the strain evaluated and the titer of the phage in the original strain isolated.

EXAMPLES

Example 1: Characterization by Genome Size

The size of the genome of the phages is determined by pulsed-field gel electrophoresis (PFGE), based on the protocol of Evergreen Phage Lab (Olympia, Wash.) from 2009. The phages were taken at a concentration of $10^9$ pfu/ml. Then agarose plugs were prepared, which contained 400 µl of the suspension of the phage and 400 µl of agarose at 1% (w/v) (Ultra Pure DNA Grade Agarose: BioRad #162-0137) in 0.5% of TBE buffer. After lysis with proteinase K (Promega), at a final concentration of 0.1 mg/ml, washings with lysis buffer were carried out. The PFGE run conditions were as follows: 6 volts, 15 h, 2 s initial switch time and 10 s final switch time. The gel was stained with gelRed (Biotium) 3× and was visualized in the GelDoc System (Bio-Rad).

According to PFGE of the 6 phages of the invention, φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 5) and φSan25 (SEQ ID NO: 7), the genome size was 170; 170; 159.3; 90; 90 and 86.7 kb, respectively (FIG. 1).

Example 2. Transmission Electron Microscopy

The pure phages at a concentration of $10^{10}$-$10^{11}$ pfu/ml were placed on a grid covered with carbon of electrons and negative staining was performed with 1% of phosphotungstic acid. After drying, the preparations were examined with the transmission electron microscope (TEM). The morphology of the phages and their dimensions were recorded.

Figure 2:
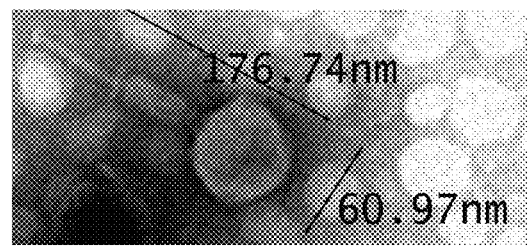
FIG. 2. Transmission electron microscopy of a phage

The phages φSan15 (SEQ ID NO: 3), φSan23 (SEQ ID NOs: 4 and 5), φSan24 (SEQ ID NO: 6) and φSan25 (SEQ ID NO: 7), which form part of this invention, belong morphologically to the family Myoviridae of the order Caudovirales (FIG. 2). The electron micrographs show that the phages have icosahedral heads with dimensions between 50 and 70 nm, with long contractile tails, with a length between 120 and 180 nm.

Example 3. Efficiency of the Cocktail of Bacteriophages in Bacterial Reduction

A culture of *Salmonella enteritidis* (OD600=0.01) was infected with a cocktail of phages, described in this invention. A multiplicity of infection (MOI) of 0.1 was used. The culture was incubated with stirring at 37° C. for 15 h. The absorbance of the culture and the bacterial count were monitored by plating serial dilutions.

Figure 3:
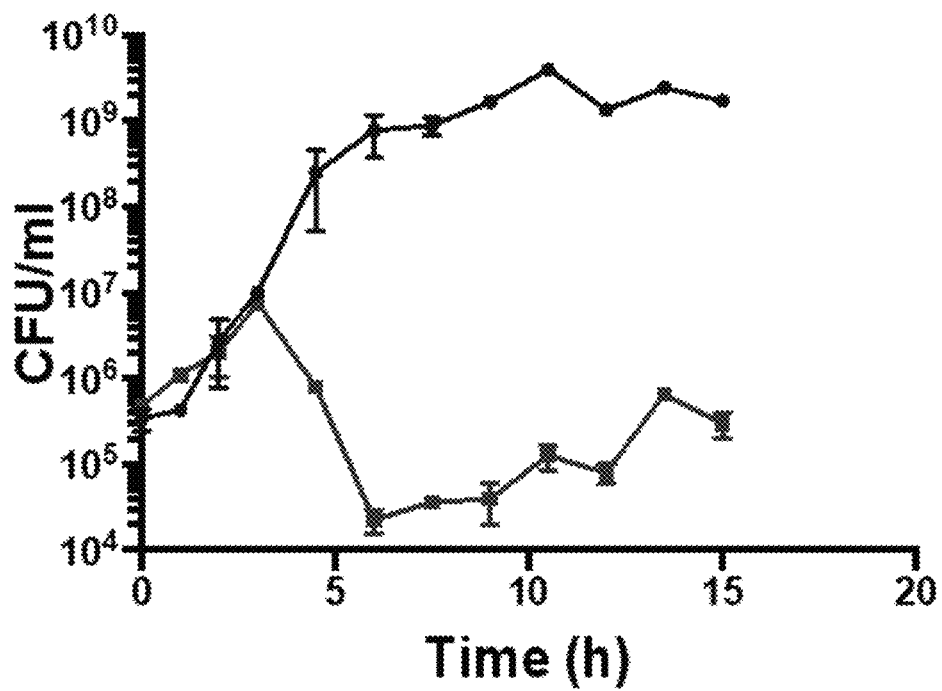
FIG. 3. Efficiency of the cocktail of bacteriophages in bacterial reduction

Reductions of *Salmonella enteritidis* of 3.12; 4.3; 3.86 and 4.29 log 10 CFU/m were obtained, among other things, after infection with the individual phages of the collection and a maximum of 4.62 log 10 CFU/ml with the cocktail of phages (FIG. 3; the culture of the bacterium without the cocktail of phages is shown in blue, and the culture of the same bacterium with the cocktail of phages is shown in red).

The combined activity of a minimum of 3 phages in the cocktail allows a greater reduction of *Salmonella* relative to the individual phages. The fact that the individual phages show lower efficiency in the elimination and/or reduction of *Salmonella* over time explains the importance of using a mixture of several phages for the composition of an efficient cocktail.

Example 4. Efficiency by Burst Size, Example of the Best Phage

Figure 4:
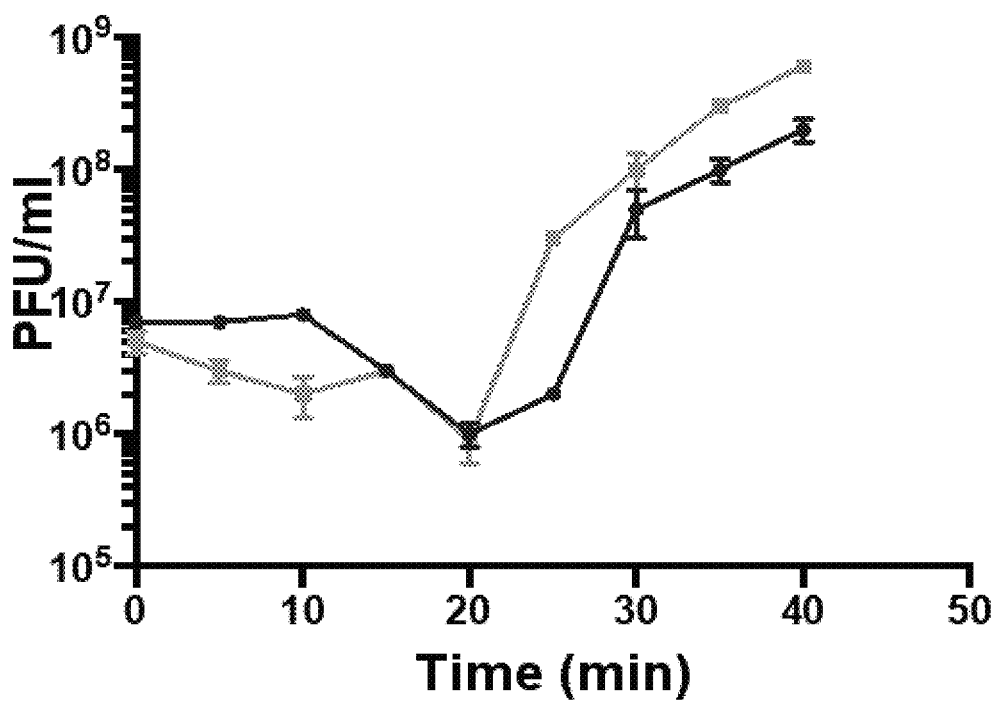
FIG. 4. Efficiency by burst size, example of the best phage

One-step curves were constructed for each of the phages φSan23 (SEQ ID NOs: 4 and 5), φSan24 (SEQ ID NO: 6), φSan25 (SEQ ID NO: 7), φSan15 (SEQ ID NO: 3), and the burst size was then calculated. The culture of *Salmonella enteritidis* s25pp (OD600=0.2) was infected with each phage, and was divided into two treatments: with and without chloroform. A multiplicity of infection (MOI) of 0.01 was used. The culture was incubated at 37° C., and samples were taken from it every 5 min for 40 min. The infected culture samples were put in chloroform and dilutions (1/10) were prepared with those without chloroform immediately in buffer SM and were plated by the double agar method. The same was done with the samples with chloroform but on the next day. Finally, a count of plaque forming units was performed (PFU/ml) and the following parameters were determined: the population growth rate of the phages (fitness), the number of progeny released (burst size), and the latent period and eclipse period arising on the unadsorbed phages and centers of infection arising from the treatment with chloroform, and on the other hand the number of unadsorbed phages arising from the treatment without chloroform (Wang et al. 2006). The burst size is an essential parameter that makes it possible to determine the level of efficiency of the phages: the higher the value, the more efficient it will be. For the phages φSan23 (SEQ ID NOs: 4 and 5), φSan24 (SEQ ID NO: 6), φSan25 (SEQ ID NO: 7), φSan15 (SEQ ID NO: 3), of the invention, they all have a high value of burst size, where in one cycle of infection of the phage, it may generate a progeny of 165 and 200 (FIG. 4); 81.6 and 120, respectively. The results show us that with these values of efficiency based on burst size, the phages of this invention are excellent candidates for the application described.

Example 5. Resistance of the Phages to Chlorine

The effect of chlorine on the infectivity of the phages of the present invention φSan23 (SEQ ID NOs: 4 and 5), φSan24 (SEQ ID NO: 6), φSan25 (SEQ ID NO: 7), φSan15 (SEQ ID NO: 3) was determined by means of two solutions of calcium hypochlorite: 1) commercial 2) directly from the pure chemical. Each of the solutions was adjusted to a final concentration of 0.000975% in sterile distilled water, which is used in the drinking troughs for poultry. The initial concentration of the commercial solution is 65%; whereas the other solution is in the pure state. Then each of the phages and the cocktail were put in each of these solutions and the viability of the phages was tested at 5 min, 15 min, 30 min, 1 hour, 2 hours and 24 hours.

The results obtained show that all the phages are infective at each of the times. The controls where only chlorinated water was sown did not show inhibition of growth of the bacterium. In Table 2, the symbol (+) represents infection of the bacterium by the phage. The results were accompanied by a description of the plaque morphology of the phage for each test performed. On reading the results, changes were observed in plaque morphology at the different times.

The results show that each of the bacteriophages is infective for up to 24 hours evaluated on 2 different samples of chlorinated water (one commercial and the other chemical). The cocktail of phages displayed constant plaque morphology over time, with clear plates, without internal growth, in contrast to the individual phages.

TABLE 2

Results of stability test in chlorine

| Phage | Time: phage in chlorinated water | | | | | |
|---|---|---|---|---|---|---|
| | 5 min | 15 min | 30 min | 1 hour | 2 hours | 24 hours |
| φSan23 (SEQ ID Nos : 4 and 5) | + | + | + | + | + | + |
| φSan24 (SEQ ID NO: 6) | + | +p | + | + | + | + |
| φSan25 (SEQ ID NO: 7) | + | + | + | + | + | + |
| φSan15 (SEQ ID NO: 3) | + | + | + | + | + | + |
| Cocktail | + | + | + | + | + | + |

SEQUENCE LISTING (7 sequences)

SEQ ID NO: 1 - DNA, 143748 bp, Artificial Sequence
  Bacteriophage San13
gggatcggcttgccgtttgcgtcgtgtacataggagacccgcgccgcctggcggttacggtaacccgctttaatttccagagtaacaaccagggccggggcgctttccattgcagcacgttgatcggcggtgtcctggatcgcttccaccataacgccggggataacctgccagcgtttaccagcaggcgcggcggtgccgttgtcgatcacttttccgccgttggcttttgcagcagtacgggcaagggcgcgagaattgaaatagtttttcatggtgtaacctcgtttgtgtggttgatttgtttcgcttgtcaatgtgtggagattataaccccacacattagccagcgtcaacaattatcttacagttattttttgacctttcacaattatataagtgtgtccggcgttactatattgatcaacgtatacccgacgatcacgcccctggaaattaactttccattgtgtagggatcttggtcccatacccggatcgggttttggttagccccttttgttgccaccacaaaggcgcgtcaatcgccgtaacttccgccaacaaagacccgtcattgtcaatcaataatgtttccattttgtttacctctcgttagtgccggggcgcgtccccggcttgttagtaagataaccgatccggacttggtgatcaagctttttctaaaatatttttcaggccgtcaaagtttgcgatgatctccgcgcctgccttttttgcagcgtccagcgcttcaccgttgatcccgttgccgttgtaaacttcttttgcttcggtcaacaaatcgctttcgtcctggtatgaataggtaaaactacaaccaataatctcattatccaggagggtgatcccgttcgcggtggcggtcacactgaaaccataatcactggcgtttaaatcgcgctccaaagcgtcctgtgcggcctcgtaagcgtggcgcgatgggttatcatcaccacgggcgatcaagtctgcgatccgctctttcaggctgtattgtaacgggatagcatatttataactattgcgatccgcgttaggattctttacagtgaccccgccctggtgatcgtcggtcaattcccactcatcgccaaatgtatcatttgtattaaagcatacaacgtcaacgctaaaatcaatgccgttttcggaataattgaaagtttcgatagtgtccatttgctttaccttttcagtgtggggcgtcggtgtgtcgccctgatgtgatacatagtaaacggcttactaactcccgtcaataccccaggacaaaaatttttaaaaaagtttttcctttatacttgttgcatcctggcggggatcgtgtactatataaggactgagacaacaacggcgggtaaagaaaatggaaaacgtaaacgtagtaacaagcgaaacaatggtgacccttttcacctgggaaacatcagcaaatcattgtcagtctagatcggtgccgttgcctcatgccttgcgtatgcttaacggcggattctaccgggcgaaagtggtagcggaaaacggggaagttttagcggataccctgtaaaaaatatttggtcctggggcttgcaatcggcgcggccctgggttatagttagttcaaagaagaggaaacgccaccccacggcgaaaaggcggggctaacgtaccgggcgcgggtgccaggtcggaaggtggatcgccggtagttcgacctgatgacatttgtaaagatttgtaaagacgcttgatccgtggagtggttatgctattatttacacatggcgaggggtaacgggaatcgcgagacaaacaccgaacctgcccgctattctgcaaatgagaatgattctcattcaacaaaaaatttctcttgacatcgcgtgtgcgtgtgtgagaaaattaccgatccctaaaaaattttttcgctctatagaaaaaatacgttttcaaaactgaaaactcgatcgagaaccgcgcggaaaaattttttcgatagacagaaaaaatacgttttcgattttgaaaaaccgatcgagtacccagtgttatccagaaaaattttttcagcgataaagaaaaaatacgattttgaaatcgaaaacttgatcgagtactcggacttaaaacccaacaaaagggatttaacatttctggaattttgccacaattatcgtaccggggcatggaaattccattagtaatcattatgttgcatgggtggggtttgggataagttgctgtactttccaaaatcttaaatcacaataaaatggatttacaacccggctatgagggaaaaccatttcaaaaaccatttcgaatttcattttgatttccagttcaaaattccccgacaaatatcaagggcaaacaaatatcattttgaaaaaccgtaccgtttcaaaacaagttcttgaagagaaatatcaagtgatttcaggtcgttatcaaatatattctcagattcccatgcagcatgtgcctcttcctctgtgtcaaaatatcctatataccttccccttgggtcatttttagatctctgtgccttgaacttacaaagttttttgtcaaatgttacacctcttgcatgttttccatttcgagaaatataactgttcaaccacacagggatgtaaatacaagtatcagggccgtaagccttgttcccttctaccagcaaatctttgtcaagtgcatatccttgttgataattgttgcaccaccatgtatgaaagttcataaaataatgccacttatcgaccacaacaaccccatgataagaggggtatttaccgctgtagcatctgtttatcatattgtgccaatccttgtaggccgtatggtgatggagttttccatctttccgcatactcgtgataaacggtgcatcgtttatgccaacaccacatactaaactacgatgttttgtagatggtttcgattccatttccaaatctaaactcataccttcctcctaaatatcacacggttttcattttggtttctttccgaaagtctctctccacccacaaatatcatactctgcatggtgcgacattttatacatcaggatttcatcatcagttggattcatcacgtccatgaaaagatccttcatctctgagagcctgaagcgatagacctttttatccttcgtcaagataatatcaatgctcccattgacagcatctattcttaaggtatcatcaccgtcacataaacacagtgtcttaccgcaaagagtgatccagtcctgaacaccaacaaccatattgtttgcagtgctcccatgcagcataagctcaacaacaatagaacctgcgtaaccagttctctcttcctgaatgatgttgaaaacaaaaccacgctgaaacttattccaaccgcgagactcaagagcgctgtaaaggctggagtctgtgttaaattcccttaccgcttctcccgacagatacaaaaactcatccgagatttctgcacgacccatcttgttatcaacagacaaaatatctttactcagggtatctgcccgtttgccaacagagatcagggagtctgtgagagtaacgacaagcgcttccagttgggtgacataattcttatagtcataaagctctgaacccttcgctatatccttcagttcagaaagctcagactctacattcccgtgtcgtttgttaaactctgcctcatcatcttcatcagttgaaaattcaaggtaagatagctcgtgctctgtgcgctcaaatatcttgagtaactcggattcaagatccgggtgagggtattcgttctgtgtatgatcgagaatctctgtggtgtggaaaacggttgtcatcttaaaagctcctgtatcgctttgtgaggcgttttaataaatagctgtacgttcgcctaccctgtatggtaaaaaccccgcagaagcgttctggttgcgttaaaagcgggtattgagccagtagtctgtgaagtcatgccaaggaccgagattaagtttaaaactcgtcttatggtctgtggtaaactcaagattgtgttttggctgcaatgtatttatcaggtacggctcgcaaatgtggaggtctgcaaggttagagaaccacattaccttcaccctgttaatatctggaatcaaaccagccttcttgtgttgattgaggcgagcattgatgtctactgtcttcccgacatacaggcagttaccagaggcatcccaaaaactgtagatagcagcggggtaattcttcttcctatacggcttcctacctgctttaaggtgtgtccacctacagtcctcaaaaacaagaccaccataataaatatccacaagctttctcaggccaccatgaaccttaatcacagttaactccggtgatatttcttgcagtatccttttaacatcatcactttttaacgtcatattcctccaatggaaaagccccgtgctttacggggcattgtggtgtcagatcttactgaccgtgcttctggctcatctgatacttcatgtatgccatgttcattttatgctttacatcataggtgattggtaagtttccgaacatgaagtatctcaggtcatacatcttctcccagaacttgaaggtgtagtaagggatcttcatcaacgcacctccacaggctcaatgaagtagttctggccctgcttcgtctgacagaaagatcctgtgtaccaaacaccacccccaactaggcttgtcttacgcatgatgtcgaagttggtcaacttttcttcacgcagtagggctgctggtgcatcgaccagtttcattagtaagtcgaaaccagacatcgacatgatatacttgttgccatcgctgtcaacaatgtcaatgtttgcagcagaccgcccacggctgaatccggtatactggatttcaaggtgacggatctggtgttgttctgatctttcgacttttcgttcaataccgtaatcgttctcataccctgtataccatgccccggtgtctttgttatacagcgcggggtatttcctctttccgagcttcgccattcaatttctcctcatttttctctatcccaaggatcataccctggagttgttgtttcatggggatcaatacagggaaatcatcgatccagatatccggtatccaccccagctttgcacagacagcggccttttgcactccgccgcagtaaatgatgcctattccaagttcttcagcccagtatttgatatcatcgttcctgtcagtttcgaatcggaatgtcacgaacttgacagaccagtctgaatctcttgaacagaagaggtggacgaactgcgaccacctttccggatcaagagtgaatgtgtcatcgaaatcaagcgctatacgctttttctcaaatgatttcactcagcccccatcttctctacgatactgtcccacttattgcacttcttgtcaacataatgttcaagacgacgctggacggtttctgcgatctctttccgatcagaatcgcgagggtttatacagtcctgaagctcaagcatgtaagcgaggtcgattgcacagttgatcacatcggcaatctctgcgattgcaggttcatcacaacgataagggcgattcagtgctcgtgccagttctccaacttcctctaccagattcatcatgacagaaacagtagaccgggcttgcgcccggactgaggactggagtacgcgttcagcgattccggtcatttagactccttctcttttgccttctcagcttcagcggcttttgcagcagaatccagttcttcggtgtacttcttgatctgcgcatcaaggtacttgatggtgctgtcagccagttgctgagtacgtggtgattctaccacattctgaccgacatacgccgccagcattttgtaagctgtttctttctgaggcatgaagtttgcatatacaatccccaggaaacataccaccataccgaacacagcaatcttacgaggcccttttgtcaggtcgcgcttaggcacaggttggcgctctgcttcacgttgacgaggtgctgttacctcccccaaaacttcgaaacgcagccaaccagaagtatcaccattaggataacgtaccatcattgtaccatcattatcaatcctggtgacaactaacacatctccggctttataattggaccagtcctgattcaggacaaggttctgccccagaaagaatccaaaccgttccttcttaccatccgtctcttcgtaagtcttctgaattgcatacatgataacatatgcaaccgctgaaatgaagagcaggaagccccaaccgccgtaagtaccatcagtagtgagtacatcaatgaggtaaatcagaaaaggccatgacatcagttattctcctatttataaaaatttggcacaattgccgaacgaccatctttacaatcaacgcttgaggacagtgcctcaaaagccatgaaggaatcaatctgggtcttaccaccacagaactctatcgcccagtcatattctttggcgttatcccttttctctggcagataacaccctgttaaaagaatggataacaaaagtggtatgaagacttttttcatttctcattaagctccgcaatcagtgcctcagcacgtttgttgttgatgccattgatattagcaggttggcctgccatgtcaagacgatttcgcaaagtttctcctgcatcgtcttcacccatcgcccagaatggctccagaccaaggaaagaacaccagtatgcttttccccacgagtccaccgctttagggcagctatcgtctgtgtaggtccagtgtgcagcgccgtaacctgtcaggccatccatagtcaagtacaggcttggcatacaatcgcaactgtcatcaacatgacaagagcaacttgagctactggtcatcacacggtacttcggaaccagacgttgaatagaacgtttaatattaaccatttttcggcctccgcgccgccccggagtagatcgggtaaacaagtttgcccctgtcgccaatcggctccgttcacattgaacttccacacacatctgaagtgcttcgctatcgctccatcacttcctcttgaaaccaactatacactaacaaaaacataaatcaagtcttttataaaagatcttttgtttttagtttttaaagaccttatgtgtattaatttatatatgtattcatatgcaaattttgcaggacacgaggtgcaaattttgcatcacagcacggtgtattcgtatgtgctcatgcctctcctttccacagataagtagccgtgtgtgaccaagttttttatagaggtactgatggacctttcagaaacaccagtggcctcgcttatcgtcttgtaacttgcgaaatatttctttgattttgtctctaagtatccggctttgtattttatatgcagcaggacacgaagatctgtacaggacagattcttgtcatgtaactccttctcatcacaagctacccacctctcgctctttctggacaactgtaacctctccacaatagacagatgataaaaatccatcgacaatacctacagccttttcaaaatacttgctttcaaagcactctgtgccaccaggtatcctcaaatccatcattggaatctgccactttatcatcctttctaaatgccctgccaggcccccattctcaaaagtatacacaaattccattgtgaaaacactaccatattgagaaagttgcttttcccgttcactagggttttgcgtaatacctactttacaaacaccatcacaaaacctgccaatatacaaagacttatttttaccaccagggctatataagtaagcataatctgccatagtaactgttttattttctcgatccaaaagcaagaaacctctgctctccagatttctcaggcattgactgaacaacccccattccatcttagtatctaagaaaagaagttctacagggtaatttttaatatctctccgagaatcgaagcatctttttaccttgcaatagcaaagaacatcatccccagtcaatttttcatcctgagtcaagagatcaggtatacacatttgctttgaatttaacattttcattctcaccactccagataatctcttaagaattcaataacatacttcttcgcatattcttcatcagcatcattatgccacatgcgggtaattacacccgccatagtgtacaaagacctctcaaatggtgaaagtccaggtaaaatactaaccataaactcctcctctgtggtgatctccagaggatttaccgtgtaatctggtgggataatggtctcccactctcctcccttgaacttcttaaggctcaaggttctcctgttggaagttgtgaggtactcacaatgctcacaaccatcctttttgaagattattcgcacaattgccccggtgtacatgaaatccacatccacaccgagaccaacggcgacgattttattttgagtgctcatctaaatctaccgcccttccgaaaggtggatcaaacttcgcacggtttctaccgcaaaggacccacagtgtttcccatttacgaccccagtcttttttccgatgactgagatcctcaatatacccatcagtgaagattatcacatctgttgccttcggaatgttatcttcgatgtactggaatgccacacctgccatagtaccgcctgtggaggttacattgtagtccagcatctctttgatgttctcctgtgtgtacactttcacatcaccaaccttcgttgaccagcaaaataatgtcacacggaatgttttataaagcagacacaaaccaataatctcgttgaagatcttggtgagtgtcgtctgagatatagaacctgacacatcaaaaccgataacgatgtcgattgtatcctgttgcttccttcctggcaagatgatactttgcttgttggtgatagcaccgtagtttcttaacacttgcgtaacagaccccgatctacgagcaggtttacggaacgaaagatgcgatctcacacgagaaatcattcgttgtttgatgatctgcatgtaatcaatatgtggtttacgcattctggctaccagttctcgtgcctcttttggtccttcaccacccgcagcctttaatgcagcctcaataagacccgctgaccatgcaaagttctcatcttttgctaccggaccttgacacgggtgtggatcagtgtacccaagaatgtcacgatctgggtcataatccccgatatgagtacccattgggtgacctgaaacagccttccctttgtgaatggcgctgtaaatttcttccgccgtcatcccgtggaaagagaaatcacagtaacagtatgccataaatccgaattctttatttttatcaaagactgtttgcgccccaccagggaaaaatcgcataccctgagaacgtggtccaagatcgcttatcacaatatctgtgttgatatactgatccgcagcaatattgtacagttttgaatcgaagaacttaccacgagccatatgatcattggttatatggcgtgtctcatggatgagaataaccaccacttcccttggtgtctttttacgatagaatacattgatatattctttgtagtcatccttctgttcctgagtcatgtgggggtgtttatcaattcgagaaaacaccttcttcttccgctcttccggcatacccatgatgaactcagggttataatacaggttgcggtggtcagtcgccgcagtcggtaaccaacgccaatcagcgatgatcggcaaagaactcagcaaagtcccgtaaaatgggcgctgttgtaacaatgcaatacgtgcagattgaatgaccttcagagcatctttctgaagcttttcaatcatttcgctttcgtctttatacatatctctctccaaataaaaaaggccatcaatcaagatggcctcagtatatgtcatttttgaatgcggatcaactctttttcttcaacgaaataatctcttccttccaccctgaatccccatgccagttttggccttggctcatacggggttggtggaacagcaaacagtacaattgcatccacctttccagaatgggcttcgtcgataatcataaccccctcaccaactacaatcgcaggcttgaaaccatgatccagcatcttttgttcaggggccgttgctggtcggcccaagatgtgttcgtacattataccaccttgttcagcatcgcggtgatcttcggcagactgagacctgtctggatcatcaattgggtcattgctgtttccattttcttggatacaatgatgaaattatctttcgcaaagccaagtttaaggtcgaggatcaggattgacttgggttcacctgtcaacttctcccctgtcatcgagcaggtgttacggacatattttgccttgaactgtgcatatgtcacacttacattcatccctacatcagagaaggttttgcagtagtttgcatacgccagagctaccgctacgtcatccggcagttttgctggctccggtgctttttctacgacctcttccacagccttggttacttcctcagtaacttcgcccttgtgcatatgcttttctgcttcctggctcagtttctcttcgatagcaatcatctcgttctcctgttgtgggatatatttagttttcagcatttccatgtggtcttttgacatgttcagcatcattgcctgaacaatctcgcgatcaagcggttcaattatagtgattgcggtcttcttgtcaaccaaacaatctttcaattcgttggcacgacgcattacaacacagacgttgccacgcacataaccttttttatcgtcgatacgttcaactgaagggtattttgggttataacccgccacggttcccatatgaaacggcatgttggtgtagtcgcaagtacccataccgagtaacttcttacccatcatgaaccaatcatcgagggtgagtgagaactcgataccacgttttcttgtacgctcaatctttgtgtggtaacgctcttcgagatttttcatctcgttttgtgtaaattcttttttccagtcaatcatgttctactcctgggttgttcccgttcttgtggggtgaattatctggcattcattccgcgctgtcaacacttgatttcaaattctttacagtgtatgctttgtgtacttttgtttgaaggaaggataaaaatgaacaaattcaacgttgatgttagacaagtaaatgcccccaaggttacagcagatatcgactggagcttattaaaagatgaccagaccactcgcgccctgatcgagcactggcaaaaagagcacgagtaccgtcaaatggcaatgatgggtgtctgggatacgccaagaatgaataccgatgattttctttcagggttgaacccaagggtgatggaagacaatcccctggctgaactactcaagggcctgcttgaaagggtggataggagagaaggaccattttcttggttctggggttatgactgggatggttatcggcgggagagcctggataagaggtttttggcccgtctggaggtagatgtcagagacagggcctttaactcaagcccgttcgagcgggaagaggtctcaagagggaatgtctctgccattatccgggggcatggggatggggatgcctttacaaagagttctgcttggaggttttcaagtcgtacaagggagtttctcagtttgttgaagcccctgatcagacaaatggggcgttgtgaaccagaccttttaatcaatgcagagttccgcagatacggctttggttcaaaattcacgcagaggtcaagaaacgatattgatattcttgggatctccttgtctatcggagatcttcttgtattttgcgacttcaaggacagggataacttcgatgtgcagtgcaaccacattggtcacagcgtcttccacttgcgtgatcgcggcgttaagatcaagaatgcccgtgaagcgttgttgatttgcaataagaatgagacattattcaccttccgttgggatgaaagactcaaaaatatgatggcaggggaaacacccagcccggaagagttaatgatgatggaaatggctggatataaagatgagttctggcttgacaacattgatggttttgatacactcaagatcaaaccttttaatatgatggagcaacaaagatggtacgaactttcaattccacgattccagttttaaccccggcgcaagaacttgctctggctatcaagatcgcagcagagggccacctgaatcagaaagacaagggcggtaatccttatatccttcatcccctgaaggtaatgcactacctgaagactgatgattttcaactcatggcgattgctgtcctgcacgatgtgttggaagataccgatgtaacggctgctgatctggtcattctgggcttctccaaccgtgtggaagatgctgtggttcttctgacaaagacccccaatcaaacaccggaggaatatttccagggcattgcaagcaactatgatgctgttcgtgtgaaacttgcagacctacgccataactctgatgttcgtcgcctgaaaggtcttacagataaggatttgttgcgtgtccgtaaataccacggcatgtatcttcgtctgacaaagatgaaagaacatcatgaagcaattaacctgttgtcacaattatgaatctcttgacactgcttcgcacaaacaagtatactcagaaacagatgggcttcctgctggggatgccctcgtggagagtgagtaagctcgttctcaagttggagaaacgtggttacattcaggtaagtcgcagatacaaattgagcgggccggtgtcaagacccttttgtgtttacgatcaaaatctttacaaagtgactctatacaggagcaaagaatgtccagaaatcaaggctacacccacaaaggcacagtcaaaaaaccccgcctcggctgggcgtggactgagaaacttcgcgaaacatctcgttactggatgtcttaccagcattcagagacaggaaaagccgtgaagtatcgtaaaactgacgggaaagtggtgggtggtgatgactaccttgaccttgaatccattaaggagctttgatatgaacaaatctttacaagaggctatcgagttaaggcgtagtaaagggcagagcgatgcggagattgtggactacctcttgaagcgctctgatcgcaaagaagaacaccttacctactataaaaatcgtgcctctgaactgaaatcagctttgattcaggcacagtttgaaagtggtcgtcgggtaaaagtcacggttgacaacatcatcagaacatgttggggaaattacttgtatcataaaaacacgcgttacgtttatgatggtaagttgaaggcatgggttaaagaccctagcaaaaacagtttgttacagcacaatatcaaacacctgccaggcaaatttcatgtggaggttattcttcctgacgaagaaatgccccggaaatgggagggggttgctgttggtaatctgtttggtaaacgcctgcttgcagtagaaaaagacgggatgtggatcaactctgatgatacattcattatcactaagaaggagaagaacaatgcgtaactggagaacccggtttgatttgcgtgatgtgtggggtcaacgtaatggtgagtgcggtccagaagagtggacagataagactgttcatgaacttgcaaaagagatcgcacgtcgaataaaacgtaagtttccacaacacatgattgatggacacgactgggaccctcgtttgacagaggttcaagacatgttcgaatcagtaccgactcttaaagagcaccgtgacatgctggcccgtctcattgcaaacgaaaatgtttgcgatgatgagatctgtgaaatatccaaagataccccgatggcgcagttcaacgaggcgatggacctgttttatgattggtgtgatagtagttctgtgtgggtggataagtgagagctttagatttttcagatgcggcagtcatgccgcttcctcgtcaccgcttgactcgtcgtgcatggtatgcagtctttggtgctcaaaagcttgagccagatgaaaaaatgttctctgaggatcttgcaacgaggattcataccctatacaatgatattgcccctgaagaaattgagggagtaattgcaaattatcttgaagaaaggagacaaacgaatgtcgagtcgtaatatttttgatgataaccggatcaccctacgtgacatcccggatttaatgcgcttctgtcagcgccgtgggcgctcgctgatgatgttcggtggtgctggcctagggaaaagtcaggcaatgaagcaggtcgcaaacatgctgtttggcgaacgtgacgacaacctgatcgatttccgtcttgcggataaagagccgtcagatgttgtgggcgtacagatcccggtcacagacgacaagggtgttacccggaccgtttatgcgatccctaacttctggcctgaagatcctaactggaaaggtatcgtgttcctggatgagcttcttcatgcggagccttaccttcagaaggttgcataccagatcatgctggatcaccgtattggcacctacatgttcccgaaaggagcggtgtttgcaggtgcaggcaaccgtcccggcgatggtactgcggtaagtatgctggaagcacctctggctaaccgtatgatcctggttgaactcgattacgacacgactgtttggctgcaagattatgccctgcacaacgatgttcaccacaacgttgttgcgtttatcggtgcaaacccaggtaaactggaaaactatgaggagatgttggaaatcaactccccttcatacgccacacctcgtacttgggttaccgcaagtgatatcctgtacgattatgatgcaggtatcttgtccacccgcctggcacgagccgctctacaaggatctatcggcaaagcattgaccgatgagttgtggtattatcacacccgtattgcaaatatggttcctatcgagggggttatggacggatcgatcaagaagcacaccgggtcagacacctcagatgtgttatggaccctcggctctcagggttcaatctggttgcgtaaggcaattcagaacaaagagtacacagatgatcaggttattgactttgctgcgaacttcttgcagtacatgtatgacaattttggtcagcatgatacgtcatcgaaccgtgatttcgtgagttctgtgtttatgtccttcatccaagagaactcttttggaaaagcaatcctgttgtcgggtgatcgtgagcgcttacctgccaaattgttgggtaaatacccggtagtaatgcagatcatcacagaataccgcaagaattttgctgaaggtgttgatgcaatcgtaaattaatcgttgacagccccaagtggggctgttattctttgctcacacaaacaaaagcgaggacaaactcaatgactaagttaaactggaaagaagcacagcaggctatgcgtgaaggtaaaaaggtacgcaaccaatactttactccagaggagttcttcgagatgaagaacgggcaaatcgtgtgcgaaatgggatacaacatggctggttggtatcttggcgaggcatggcaggatgagggatggagcgtgattgatgcgtagacctagcttcgggtatatttatatccttgataaagatggtgatgaacgttttgttcgtttaggctctcttgacatagaatatgtgaaggatcagtacggcccagacgcaaagaactgccacatccgtgaagacaatggtttttgtcaatcttcctggatggctggagagagtgctggggctatattagccaagatagcggagcacgacaaagaatatgttcactttgtcagggatttcgcacaacggaacagaattgttctcatgaagggggaactatggtaaaagagaaacttcgtccaattcctaattatgccgatgtgatggatgtacattcatgggattgctgtgtaaaatgcggtgccttcattcctgatgatggaaatgggtactggtgtcctgatgaaaattatgagtccgacatcagttgctggagtccacgtcctgaatgggcgacccacgtagcgtggtacaatcgctaatggcaaagttcaaatttccgctgaaagagatcaacgaggtttggtggattgatcgctttgacatggtgatggctggttacacataccagcgtcagcgtatttttgttgtctgtgctaagacgaaggctgaagctcgtgaaagcatggacgcttttaaagagaggagttgtgcatgaaagtaaaaatgaactgcaactacagcgaccgcttagaccatccccgtgctggagatgtcctcgatgttttggaagaggtttataacgggactttcattgaatattatcgttgtgaatggaaaggtggtgaccttgacgtttacccatacgagtgtgatgaggtgaagaaataacatgaaggagagtgaagaggcattgcaggcgcttaaatcttccttctcatatgaccctgagacaggtttgtttacgtgtataaaccctctcgctcgtcgtcattttggaaaggttgctgggacaaaaagaaaagacggttacgtaaggcttggtgttaaaattgaaggtaaaggtttttacttcttggcacacagggttgcttgggctttttattacggggtatggcccacttactttattgaccacaaggatcgacaaaaagataacaaccgcattacaaacctgagagatgtccagaaatttgtaaacgtttataattatagcaggggtaaaaagaaccaaacaggtttccgtggtgtattcgtagataaaaggtggacaagactcagataccatgccgtgtatagcaaaacccaccttggaacattcgactctgcggaggaagccagtgaatgttatcaagcatacgtaaaaacgattcatgacattgtagtggaggactgatgcttaagtataaagtaggtgacctgattgaggctgtgaaatctggggaggtcaatgtattcgcgcatggctgcaattgttattgcacgatgggaagcgggatcgctcctctaatcaaagaggcgttcccaaaaatgtacgctgccgacctgaaaactgagaagggcgacaagaccaagctgggaacctgtacagtggcctttttgaatgatgggtctctcgcaggatttaatctttactcacaatacggctataatcgtcgtaaacagggtctcagggacctcgattacaatgccctgtacgattcgatggttgaaatgaaaaagctcttacagagctatacagacggccctatggacatctatcgaatcgggttccctaaactaggtgctgggcttgcagggggtgactggaatgtcatcgaagcaatgatcaaatcaatcttccacgattgtgatgtaacggtgtatattttaccggagaaaaaatgatggtggaaattatctatcttttgatagcattcattggattctacatcttcattaagaggacgcagagagatttcgggagagtcgatagtgtagatctctttgctgctatatgcatgggcttgctctggcctgtgtacttcactaatcttgtggtgctgcgaattatcaacggagactggaaatgattgaactatttcctggaatgaaggtccatgctaaaagtgtggatgtatatgcaacagatggaactgtatttacatacagtgctcctcgtggcaaaaaaatatgcactcatcttgatgacagatgaagatcctagagatgatgttgacaatctcgtaaaggctaatgagtggattgaatcccttgggtggaaacacgagggggatgactgatggaagaaatttacgttatcattgatacccacaatgcaaccttctggaagtctgctaacgacaagacatcatggccttctgcgggaacagcgaagtctgcttttggttcaagtcgatacaatccgctgcgttgtctgtactcccagcaggaccgatttaagatcgcgaaggtaaccaccgcaggggtgatttatgagtaaggacagcgtttacgtcatctatgataaagaggatgactgcctgtggcaccataaagcaaagatcggttggataagttccggcgctgcaaaaaacgcctggaaccttggcaagaaaataaaatttgacaaccagaatcgttatgttgtagtctgtgttaacgaactgctggttaagtctttaattgaggagaagagaaatgacaatgagtaaatctgtagcaggtatcggtcagaccgaacaggaagcggtatacattggtggtaagcgttttgctggcgcacttaccaatgcccgtcctttttacggctttggtgacacgaaggatgttcggtgcatcaaaggcttttgttatcgtgatctgaaaaatcgcggcttcgacaatggcgatatccgaacctctgttgtaaaagaactgatcattcatgagcgtgacatctacgccatcacgatgaacagtgcttatcgactggacaacgtgtgcctgctggcattccttgcttccggtgtggcgtgatgacatccttaagctgcttgcagatgcaacgaaagatgcttatccggaagaaggggttctgtccgtagaggctaatctgacctatcgtgtgaccccagaatatttccaggaggccacaaaacgtttatctcccggcgaatgggttgtcacccaagcagattctgtgaagcgcaccctgaaagtcggtaacgaagtgtatgtggaggagaaataattgactaaagctatcaaatacccaagcactaaccagttccgtcaggtgatccgttctgtccacgaccgtcttacctttgacggtattgatgaaaacggctgcgtaaaacgcaaggttgttaacccgactgagtttctcctgccatacgtggggactgtgaagatccacgggaccaacgggagcattgtgttttactccgaagatgaagttgtgtttcagtccaaagaacgtgttctgtctcttgagcaggataacagcggcttcatggcgttcatggtgcgtaaagatactggagcactgctggaccaggtaaaacacatctgcgaaatcaacgaagtcccgttcgagttcccggttgaaatcgctggtgaatgggctggtcgcggtattcagaaaggtgtcgcagtcagtgaggttgagcagttctttgccatcttccgtgttgcaatcggtcagaaagaaacctcactgaaatggttgccaccaagcgcaatcttcggcatgggcctgccggaacagcggatcttcaacgtgctggatttcggttactggtacgtgcatatcccgttcaacgaaccggaaatggtacagaacgatctgacaacgctgaccttgcaggtggaagctcaatgccctgctggtaagttcttcggtgttgagggtgtcggtgaagggatcgtgtggtctccaaagagcattgaactggcacaagattccggtctgtggttcaaagtgaaaggcgagaaacattctgtctccaaggtcaagaccctggcagaagttgatccggtacgcctacagaatatccgtgagtttgtcgagtatgcggtcactgaaaaccgtctggagcagggtctgggtgaagtgggtctcgaccagaccaagatcggtgagttcatcggttgggttagccgtgacatcaacaaggaagaaggtgatgttctggaagcgaatgccctaaccatgaaggatgttgccaaatttatcagcaacaaatctcgtggttggtacatgcaaaaactgaacgaggggctgtaatggcccttatcgtatccacaacccgtgcggttaaagacaagcctttgaaggcgcagtgtgaaactttaatcttcgaggatgaagaacagggtagacaatatgtggaagaacatgctacctttgtcttctcagttcaaaaagcgaggattgtgaagaatggaaaaaccgaaacccaagtttgaggtgggacagaaagtaaaggatcttcttagcggcaggatactaagcataactagtcgctgttactttagtggttgggtatactctttcgattctgtgggtatgtatttgtacccagaggaagatctggaggctgtaaatgggactgcgtgagtggttaaatgtgaagagaagacaaatggaggataacgtggtaaactctataagtatcaatggcaataccatcatcaatggtaacgttgttggtggtgatatgaacattacttcccgtggtgataacatttacatcaacggcgagttagttcacaccacgcaagagaagaacatcactgtggttattcatggtgacaccaagggtatttccactgttgctggtgatgtcaatgtttacggcgtaaatgctggcaatatcaagacaacttctggtgatgttcatgttgagcacggcgcactgggggacgttaccacagtgtccggggatgtttatgcagaaaagatcgaaggtaatgtgaaaactgtctcaggcgacatctcccgccgttaattgatagcccctttcttggggctttttaatttggagcaagatttgaaaataaaagcaataatcctggcaaccgcctgtgcattttctctgactaccacaccagtcttagccaaagaaaacgcaaagaagcccaaggtgattcatctttgtaaaaaagatgatacagcggtaaacatcttggcatgtaatatgtatcgtgaagcccgtggtgaaagcgatcatggtcttatgtcaatagcttttgtgacgcttaaccgaaaagacaatgataagtttcctcggacggtgaagaagattgtctaccaaccggggcagttttcctggacatcctacagtacaagcttcaaagtgtatgagaaagatcgttgggaaaaggccaaggagttcgcagaggtattgaccaagatccacaacaataacaaaattgtttatgatgccattgacatcaccaagggatctacgtattatcattcaaagaaggttaagccttactggaccaaggcgatgattcgcacggtcagtattgataaccacatctactacaaagaaaagccggacccccagggagcctgaacttatgaagaatttttttgctgctttgtgtttgcattatcccgtatcttgtgatactgtctattactcaatggatgttctgggaacaagtgtcaggagcgtatcttcttggattactggcaggcatctacatagtgcggaaagctcgcaaaagaaaccccataaataactgcaaatagaggagagaaggatgataatccaacgtgccgaagagaaggtccaagtatccggtagtgtacagcgctatcaggctgggatcgcgattaatgctgagactttcagtattcttatcgacggtatttataacgacaaagttctggcggcggtgcgtgaaccgctgttcaacgctgttgactcacacacggaagctggttgccgtgataagccgattatcatccactccccaaccgacctggagccttggtactccgtccgggatggtggtttaggtatggacttcgacatggttacacagaccttcatgatgttggggacctccactaagcgtgactccaatgaattgattggggccaaaggcatcggctctaaggctccgttcaccgtgaccgacatgtttacggtcacctccgtcaaaaacggtatgaaaactgtttactcggtgcataagaatgagggtattccagaggttgttcctctgcacgagtcgaagactacagaggaaaatggcgttgaaatcaaattcaacgtagatccttctgagacttccaaatatcgccaggcaatcgtgaagtgcctgcggtatgcaaaattcccgtatgagatcaatgatccgtttgtgacctctgagatcaatgaccgaacctacccggttcagtatcgttatgaggacaaagaaacaggttggatgctggaaatgtacggttccgtatcccgcaatgcagacagcgtggttgtgatgggccagcaaccttatctgtcgaactatctgtccagtaataagaactggcctatgatgatggtttctattcctatcggggattgtgatgtgaaccctggtcgtgaatggaccatcgaaggtaagaatgaccgtggtttccgtgatcgcctcgaaaagtttgttactgaggctattgaaaaacgtggtcaggaagtcgtggaagagcttaagcagctacctacactgaaagaagtgctggagtatatgaagcgtgtcggtggctacttctcaacccgttacgggtcggggtttatcgcagacaagttccatgaccactttgggactttcagtattgacaagtgcataacttatggtgagaagggtactcgccgtgaaactgacaagacttacggttatgctgaccttatgaacggttcgccactggtttacaacgatgacggtaagtgcatccgcaccaaatgtaactggctgtctgagaactgcttcaaacgtgtctacgttacggaacgtattgaggcgctggagatcctgaaagacccgttcttcgttggaatggtgcataaactttccgaccttgagaagcgtcctgtcgtgaagggtgagaagaagtacggtggttatggcttgtacgaacctggtcacaaagtgtgggttatcgaccaagagggttctatcaagagcgaccgtatttctcgcgccgactttgatgatatcgaagccgccatgatctacagtggtggacaggtgaagggtaattgtgatcttggtgctgttcagtatctgcaccgtaaacaacagccagagactttcctgaaggacttgggggtcgagggcaagatgtatattgtgcctcttaatcgcagtggctggttacctgatgaaacaaggatcgttaccaaagatgacctttatgagcttgcaaaacagaatctcatggagtatcatctgaaccagcgaaccaattgctcatcaacttatcgccagttggtgaaggagcttggtatttttggggttaaagttgaaaccgaccctgagtataagcctaaagtgaacatgtcttattcgctttcgaacatcaagggatattacgctctggagaaaaaggctgaaaggattgtcaatgcacgtatgcgtattggtaaaaagcttttggaagttaaaaaatctcgatacccgctgctcaagtatgttgacctgaagcacttcaacacaccagagatgattgagtatcgacaacttattgatagcaaaggagaaactaaatgagtcagttattcgtatcccgtagcgcagcgcgtaagtttgcagcagacaacggcatgaaggtcgtggaccgtggtttgtctccggctgtactcgcaaccgggcgctggatggttgtaccaaaagacagccaaggggcatctaagcccccagaggtagatatgagtttcacctcggaagccaagcctgctcaggcttcacagttcttcgcaagccgtggtgatgcccgtgattttgcaaaagggaaaaagaatgcgaagatcattgatcatgcgaaaacatccgatggtcgtgataaacacgagggtgtggttaaagacctcggtaagcaggggaagcgctgggaagtcgtctttgacgttaccgatctgcatatcgaggccactgtaaccctgttgcctgaaccacacaaggttcctgtgactgtggttgttgaagagtccgagccgaagacgtacttcgacgaagagactgttgagaagaaagaccctgtggtcatcatgactcccggcaatgtttgcatctcgatgcctgatggtactcagcacaccatcaaccgtgacaacgatatcttccctgatgtgggtctactgctgattgagggtgatatcgaaggggctatcgcgctgatcgaagcaggtaaagaagccaaggctgaaaaggttgtcgatctcggccctgaccttaaattgctggatggcgttctgtactggcacggtcagaaacaggaaagcaccctggctgatcgcattcttaacgacattaagaatgatacgttcgatgaccgttatgttaagttcatgcagaagctgatgcacaacccgtcttatgcgtctgtgaaaatgctgtatgactttattcagcacaacgatcttgagattcttgagaacggtgatgtgaaggcatataaaaagatcaccatcacaaccgatggacctcgcgatagctacacaagaaaggttcctaactataaagggcaaatcatttccatgcctcgaaacatggtggaagataaccctaaccaaacttgtagccagggtctgcatatcgcctctctagagtatgctggtgggttcggtggcaacggactgattgaggttgcggttaaccctgctgatgtggtcagtgtaccttacgactacaaccaacagaagtgtcgttgctgccgttatgaagtcctgacaggtgcagaaaaacccgttggtgcgccggatgtgctggttatcgggacgatgggggaaattctggaagagatttacctggaagaagaaactaaggaggattgatgtcagattttggtgtgggcgttgaagctgcccttggtgctgtcatgtcgggggataacgtattcgttacgggacccggtggtagcggcaaaagttacaccataaagaccatccaatcgctctacgcaggttcagtcctcacagtagcccctacgggggctgctgccattaacgtcaatgggatgactgcacaccgtgcgtttgggcttacaatgggggttgctaccaaaaaggatactgaagagattaagccgaaagtgaaacggctattgaagagtaaagcgctaaagatcatcatcattgatgagatcagtatgttcagggctgataagttgtgggaaatggatatgaaatgccgactcgcaagaaagcaaccaaataagccgtttggtggtttgcagatctgcatgtttggtgacttcttccagaacccgcccgtccttaccgagacagaaaaggagacgtatttccagttccattacacagaattggcttgtttctcagatacttggaaggaactcaatccttatccaatactacttgaaaaagtttatcgccagagcagtgtccatttctcaacgatgcttaattgtctgcgtcgtggacagcggattccagaaattgttaaattcatgaacacgcattgttatgatcatggcaagcctcttgatgccataacgatcacatctacaaatgctgctgcggataaagtaaacaagaagcgttttgatgaggtccctgggttgcctacgttgtacactgcgaagaaatctggtgagtttactcaaaaacctgttcctgaagagctttacctgaaggaaggagcacaggtaatgattacagtaaacgaccctaaaggctttgatgagccagagtatgtcaatggttcccgtggagagataatcgaactcggtaaggatagtgtgaaggttcgtttggactgtgggaaagtagttgatgtagatgcctatgtgtgggagaatgtggaatataacccaatcaaggtcaggaattctgatggtacaacaaccgaagagattgagaagatcactatcggtgaataccgtgctctccctatccgtttgggctgggctgtcacaattcataaagcgcagggcttgactttacctgaacttaatatagactttggttatggcgcttttgcacccggtatggcttatgttgctttcagcagggctacatcagctaaaggattaagactattgaaaaaggtcaaagaaaaggatattattgttgaccaacgtatagtaagattttatgaagagactttcccaggtaaataggagataaaattatggcatcatactctcgaaatgagttagtcaagaagttccaaaaggaacttgaagattggaacaacgccccagccgcaagtgcgttgaagccaccgaaggatactacacatatccaaatggcctctcttgatgagatgatgtcagcatacggctacgttcctcgtcgtgttccacaatatccgaacattacagatggtcgttttggttaccagtccctttctggtaatgattttatctccctggaagatgcggtgtcataccacaataatgcaatgttccgtggtaaccctttcagaaagattcctgatcgtttaagcttcgctcttcaaaaccgtattgtggagcaggtgtctgtacagcgtgataaatcccgctatgcaggtggttcaggtattaaatctcaaaaattatgggtgaaattttatgacatttgaagttgaagatttttctgatctgaagaaagtttcaacagaaaaactgttgaaacttcgagatgtggctaatgataattataacgaggcgcatcgtcacatgacaaaagccttgttgcatttgtggtcaattaaagacgaactggagttgcgtaaaaatgctgaaaaaactatttaactggctgtttgccaagaaggaagaacctcatcgtgaagttaatgtgttcgatttcacaaaacgtgaagcagggcatgatattactcttcgcatgattgatgatggggagtatgcagaggcaatggttttccttgctattgatcaacaggcaccgggggttggcgactttattgttgtcaatcttgaacaatcctctatgcagggagaggttgattaccacatgacttttgtggttgagtctgtgacttgtattgcactgggtatttcccagctaaccctaacccgctacgaaggtgcagaagatgagtaagtcccgtaaagtcgagattgaatttgagtacaagcacccaaccgaaggtgtggttgcagtagaagcactttatactgttcagaagccggacttttacagcaaagagagcgattgggattacaatggttttcaggacttagaacattatgctgtattcaaaaacggcacccagatcctcgttgacattccagatgatgtcatgtaccatcacctacgtgaacatctgcgtaatgcagagatcgaaggttgtttccatcgtgaggaggaattctaatggcaaaaagtgaagttaaactggttgaattcaatatgaagcagaccaagaaagaagaggctgaagaaattctggcaggtcttattgatgaaggttttgtcctcatggggcagcacgaagccgaaggttggatgaattttacaatggtaaaatccgataattcactaaacgttgtccttaatactgatggcggccttacacctgctcaccagttccaggtggtcaatggtgcagcagagcgagttgttcattgaggtccgtatgaataaagtggtgtggagccttttcgatggctccggcatcatggggtgggagtatgctaaaaatggttataaggtgtactgcttcaactttgatgctggggatcatggtggttatgagttggtaagggttaagcatcctaatattcagtatgtcaattcttggatcgatgagggttttgatccagagaaagatgggattcctaagccagatattatctttgcatttccgccatgtaccgatatggcagttagcggtgctgctcattttgcctcaaaagcagccaaagaccctctttttcaggtcaaagccgtgaatacagctaaggttgcagcaatgttaggagataagtacgggtgtccatacatgatagagaaccctgtgagtgttctgtcctccaaatggaggagaccgaaccacatgttccatccgtatgaatatgggggttatctaccccatgatgatgttcatccgttcttccctgagtatattaatccgcgagactcataccctaaaaagacgtgtctttggacgggtaatggttttaaaatgccacccgcaaagcccgttgcggtagcgaagggttactcagaacagcataaaaagctgggaggaaagtctgccaaaacaaaactgatacgttctttaacaccccgtggttttgctgctgcggttttttattccaaccagtaagtgaggctaagtgaaagagttattattagttggtggtcgagcagggccatcagatggagatacacgtatgctgctacaggctgacaaagtgagtggcatctaccccatagatcaagcaaacccgtcgcgagcattcacaagttacgggacccctgctggacaaagtacagtgcaggctaagtttggtcaatattcgtttgactgccgcaatggtggttttcaaatgtctggaacagtaaaacctgatcttgcatttgcaaaaggtgatccattcacgattgagttttggtcgtacaacacggcagtcgatagtgcaacctggtggatgtactttaacacaggaacttcttcctgtttaaaaacctatcagtcaactatttatttgcaggataactctgcttctgtacaggttggtccactgtcacgcataccgacgaaccagtggaaccacatcgcgattgtttacgatgggacaaatctccagttctatgtgaacggaaaccgcattgtatcgcaagcatctgctggcggctggagtacagcttcatcatttgcaagggtgatgggtggtgagggatcagcgaagtgtttcatggatcagtttcgaatttcgggtgttgcgaggtattcaggtacttcattcactgtacctacagcaccttttgatatggattaggaggtaagttgaaaaatgtggtgatcgcaaaagcttcaaccctacaaaagttggaggataatttgaatttcttttttgagaaggggtatcacatccaaggtggtatttccttccaggatggactttatattgctgttgttgttaggccgttttaaggagagatgatggggaatggtccggattggggcagcattgtggagtaccgagacggaaagctgtactggaaagtaaacaccttctcaggtagaaaccacaatcatccagcggcagttattggcaaggaagctggatcaatatctggaaagggatattgcactatacgctttcaagggtacaggtgttataggcatgttatcgtgtggctgcttcaccacggaccaatcccaaaaggattgcaggttgaccatatcaaatcgttaagggagacaggcggtgttgccgatgaccgaataactaatttacaactccttacaagaggtacaaatactcgtaaaggtggtggtaacatgcctaattcttccaacaagtcttctgcaagaagaggggtttcttgggatagaggttatccatcaaagccttggagggcaaggataaccgtagacggaaaagttctccttaaaaattttgagagttttaatgaagcctctcagcaaagagagttgtgggaaaaagagtattgctatggaggattatgagtaattttgatttttcggcttatcgacaaggtggacaggaaaacccgaaagcacaaagatttggcaataacggcaatcgtggaggaagagtgagttatcagcagcgcgaagaagagaccctggaatctgtagtcaatggcacccgtattctggcagttcctgaaatgagtctctcgcttgatgcagcgaagtattttaaaatccggtctgctgtttcagcaagcgacggtgtaaccattacagcaacctacttgccatattatgataagtacggtaagcttactggttataagaaacgtgactggacactaccaaaagagaagaagggacacttctctgtggtcggcactgtaaaggcagcatctcagttctttggtcagcatgaagctgctatgggcgctggtcgtaaacagatttttgttgttgagggtgaaggtgatgtgactgctgggtggcaggcgggttttgattttgtcaaagctttagctgcaagccccaatgccccgaaaggggtgaaggattgggcggcaagtgttctgaaaggtatcactgccattcagaacggtgaggaagttgcaggtattccgacactgccttttgtcggattaaactgtggcacagctaacgcagttgacaccttcgctaacaatgagaagtttatccgtggttacgaaaaagtagttcttggttttgataacgatgaagcaacagcgctggaaaaggaacgtaaaatcaagaaaggtaaggaagcgacagatgatgttgcagcattcttgctgtcagacaatatctttgtagctcgttaccctaatgaacgtaacgatccggctggtgttaaagatattcgagatatgtacgatgctgggaagggtcgtgaaatctggaacatgttttccaaggcagaagacaggtatgtccctgacaaactgatcagtctgagcaatatcaccattgagaaccttcgtaagaagaagaaagatggtgttccattaccgggtatgcctcgactttatgagttgacaaaaggcccacgtactggagagctttggacactgactggaccaagtggcgggggttgacaaactagccccttcatgcagtaatgtatgaagaaaaccttgtgaattcggtgaaaaccctaacgtgaagacgagggcaataccgagcgaagccgaagagtctctccttttataaggagggattatgtggaaaagtatagaaaattttgatggatacgaagtttctgacaaaggtgaagtaagagggaagagaggctcgattataaaacctgataccagtggcagatactaccgtgttagcctgtgccgagaagggatagttactcggtggatggttcaccgtcttgtagcttttgcatttttggaacccatagagggtaaaccttatgtgaatcacaaaaacggtgataaaacggataactcagttgacaatcttgaatgggtaacccaacgggaaaatcaagaccatgctgttttaacaagcttgtgtcctcgtggggaggaaatatggacatctaaagtcacagagagtgaagttcttcagatagcagaaactttgcaacttgaacttccagtatcagaagtggcgagaagattttccgttccttttcggattgtaaaaagaattaaatacagagaaacttgggaatggttaacctctgaatacgaattcttttcaggaagaccaaaactaaccctgctttcgggagagcggcaacagatatacgacctgttgaagtatggcttccccagcagagaggttgccaagatgtttggtgtttctaaaacgactgtattaaacatcaagagagacttttcggaacgtgtaacgactagccgtgatgagtgtaacggtgtacatccaagtgggtggaagcgcaaggcatcctgaaaggatgatgatatagtctgctctgcatggaaacatgcagcagaccccgatacgagataggggtcgggcaaggaataacgaaccttgctgaacataaggaaaagtacaatttctcgcaagattgagtacgccatcgtggattatcttcgcaatatggatattcctcgtcttgacgggtggactgagaacgagaaagtggcaatcattcgcctggaagaggatgaagaagagtctgtaaacagcctgtatgctgaagagttgaaagttgacccgaaagcatttgttgcagatcctgagcagttcctgactgaggaagagcaccttgccattcaccaacggtggattgctgaggacaagattaagatctttgaccacttcggttctatcccgactgatcagttgattcagaagctgaaacagatggtgttccttgatggttgtaagtggattatccttgaccacctgtcgatggtgatctccggtcttaagtcagacaatgaacgccgagatttggataatatcatgaccgagcttgcggcattctgtaagcagtatgatgtgttcattctcagtattagccacatgaagcgtaaggagcttcagttaccgaaggataaagacggtaatatgttgcctttctggtatcctgtacgtaaagaagacctgcgtggttctgctgcactggaacagctttcctggattgtattgggggttgaaccagaagaactaccagaccgctctcgtggacgtgtgcgtgtggttgtgatgaagaaccgcccacacaaaaaacttggtgtcgcagacactatgatcatggatgaaaacggtcaattcaccgatgcatctggttgggtatgggaagatgggatgttcaagctggacggggaagtcatgcttcgccctgaaggtatggttcagaccctacaactggagactccggtgggtaaggtcaatgtaccagcacctgtcgtggagaatccggtgcaactcccatcgccagcagacatggatgaggatacgccgttttgatgatatattaaccaactgagaggtgggtgtcgatacagaccaacccaccttgcataggaggagcatgaaaggtttgtttataacggacaacgaagctgatggtctgttagaggaagtaactaagtaccactgtacccttctgaaggaatacggtgttaacaactggaatctgtttttagatcctgcacacccagagtatgagagcgccgtaacatatgctcgcagcaagacagaagccaatctcacgatccgctcatatgacgagcttgaggcgttcctgaaaacttgccgtggtattgcgtgtcacaacctttttggttatgatctacgcctctggaagaaactgtcaggcattgagtacgacatgttcaaagaccctaagtgtctggggacgattggggatacccaagtcaacctgtacgatactctgtctatgagccgtgtactttatcctgaccgaccactaccaaatggctgtcctgattcagttttgaacccggtaaccgggaaacgtgaccgtgttggtccacatggccttatggcttggggctatcgtgtggcgaacaagaaagttcagattgatgactggcgtaaccagccgctctgggagtacgttaaccgtgtgtgggaagacgttctgatcaacgaactgacgtggaaagcattgattgatgaatccactggtgctcgttggcccgatgacaagcagttcatgtacacggataaacccgaaggtattcgccagattaactggaaaaacgctcttcgtcgccgtatgctgacggattacctgatgattgagcaagagattcagggtgttccgttcaacaagcatgaggcggaaaaacttcgagatcgcattgatgttatgatgaaagagatcgaagaagaggttgaaccgttacttcctatgaaggagatgacaaaatctcaacaacctaagttcccagctaacccgtttgatggtgctggtaatatctcccaccacggatggaactggttacagtacaagcttgggtatccggttaaccgcgaggcgctggagtttaagggtccaccaaaaaccgctttcaaaagtaatggtgaggtcagtgcggcaggggaaagatactgcatccagaacggtgttgaagaccctatgcacttcggggattttatccgggaacaaaggaataaagagaataccctggtgcctctgccacctgacctgatggagaaggccaaagaggatttgcggaatggtaagatgcctgacctgatggtcccgatgaagatctcgaaccaggacgacatcaagaagtacctgatccgcgatgctgactggaagcctaccctgtggcgtgtaaaagatgtgaccaaagatcagttcaagaaggccagaactgacccagagattgacgaattagtcagaaagtacattgaggagcttggtgaatcagagtataagtctttgattattgagcacttaaataacacagacgacaaattcaacatctcagagcgcaagtttgatcatcgtcatgcgtctgacaaggcgtatgcggaaatattcaagaagttccggcgcaaagctcgtcagttaccaacttcaccacagttgaaggataacttcggcaagctatgtccgaacctcgaacgtattgatgttcacttggcaaaacagatcgttaagtggttgtcactgcgtaaccgtcgctcagtcctcgacccgattgatgaggataagaatgacacaggtttgctcaaccaccctcgcctggcgattgatgggaagcttcctgcccgtttttctggaatcaccaacaccgggcgttgcaagcacaccatttgtgcaaacatgcctaagccagatccgaaggtgttgctcggaaaagaaatgcgtggattgtggggtgttactgacgggtattatcaggtcggtatcgacggctccaacctagagggcatgatcgccgcatggggtgcataccagttcgatggcggtgaatacttgcggatcatggagagcggagacgctcacgcacgaaacgcagaagcgtacaccaaagcttcaggaaccctcgttacacgtaacggcggtaaaggtgtaacctacggtatcatgtacggtgctcaggcggcgaagattgcagcgatgttgaacatctcccttgacaaagctcaggcggtaattgatgctttctgggatagcaacttcggtttgaaaggtcgtaaagaatggctggagaacttctgggaagcaacagggaagcgttatattcctggattggatggtcgtaagatttggacccgttctaagcactcgttactgaatgcttaccagcagaacggtggtgcatcactgtttgaccttgttggcatcctgctacactgggaactggtgaagcgtgggtggtatgatgacgatgtacgtcgcctgatctactaccataagtaacattgtggctttgtgaggtaactcacatcgaataactcttttaattgtcgggaaggctaaggttgacagttttggtagactgttatactatgctaatccgcagcgaagcttgtcaggaattttagagacaagaacgttcagagactaattcacttaaaacaatccagctatatgcgaggagatacatgaaaactaccaaaaaggatcgagacatgctgattgccattacacttggcgatggatggttatccaagcatggtcatctcgaagtgtggcactctatccaccagaaagagtacacattgatgaaatatgagaagattaagaaattttgtccaagtggtattttataccggaaaaacagcttgggtaaggaacaggtgggttttagaactaaaagattacctttcctaaaattacttcgtcgtattttgtatcctgaaggtaaaaaagttttcagtggtagattactaaagagacttggaccagagcacttggcgatattgtggatggacgatggaagtttaacgaccctgaagaataagaagggtgttaagtcatcctccagatatacgttaagtctttgtactagcagagagcaatgtttgctagttgctgactggataaaatctcttactggcgtatgcccttggataagaagtgtcaggggtggtaaatatttctctctttgttttacaacaggggaggggaggatttttagccaagtaatacgaccattcatgtgtaaaagcatgatgtataaggtgagccaagattaattcttgggtaagcgaccaagtggcgttgaaaaagagagcatcccttgtggatggttagatagtccgatcctacgtgaaaacgtatggcaacacgtaatggtgtgggcgagattaacgacctcgctaaacttttggatgaataccagctccaggttcctaagaaatacttgaagaagtgggagtttgataccctggaagatgcaaaagctttcgtaaaagaatgggaagcaaaaggccgcgtatttgacgggcatgagtggagaaaggctgtaaaagacgagaatggtgaaaatgtcaaggatgccgaaggtaatacggtgtatgagggcgtctttggtgaagatgggaagatacacatccagtattgccctgttggtgagatggtggtgaaatgtgttgagaaagctgctcgtatgatgggttctccggtgcatatcacaggtgcttacttaacgggtaaaaactgggctgagtgtcactaaatttaaaggggcagacgcccctgttcttggagactataaatgtttgagatgatgcttgctacaagtgaaacaaagaaatcgattcctgttggtaatgtggaatttaccaacatatcttcctccccacaatcatggactgtccctgccaatgtcgaggaggtcagtgtactttgtgttggtcaaggaggggcagcacaaactaatccacttccaagacgtggaggtgcgggtggagacttggtgtggagaaacaacatcccagtttttcctggagagattttacaagtgtttacacaaaataatgcagatgggacgacgcttgtaggtttgtttcgtggttctgtaccactagtggctgctggtttcgggtcaggacctgaaccgtacacggggcaatacccagatatgggtgatgcagtgataaataaaggcggcgcgggtgggaataatacctcagccaatgatataaaacgttgcagtggcgcaggtggtgccgcagggtatattgggaaaggtggtgatggcggtaatgcatacccagcatcaacaatgtactctcaaggccaggatggtcagggaggcggtggcggtggctcatgtggttattacttctctggttccacatctggggagaactccggtggcggtggcggtgtcggaatctatggcgttggggtcaatggtcatggaggtagaggtggatattcaccaacaatagcaagaggcgggtctggtggggcagaccctacaggtcgccagggtggtaaatttgggggtggggctggacacggatcttcaagctcacctggttcttcagcggtgcggataatctggggaaatacagaaaagagagaattcccaaacaatgcccgaaaggtataaataaataagaggaggatgtatgattaaagaaggtcagttggttagattgaaatcaggtggccctgacatggttgttgagcgtatctttgaaagaccgctgacctccaacggggtaatcagtatcgttaaatatgctgcctgctcatggatgaatgaaagcaatgtgaaacaggtggaagactttgcttttcctgcacttgaaattatcggagagtgatatgaaagtaaaaggcacacaaaccacggtgcaaaccgtggatgtggaactaagcgatgctgccatcaagtcggttgtttatggtcagacgattgattatcttgcagatgctgtggaggaaaaacttttgtaccgcttcctccacagcttgccaccggagtttgacggtaaaaggacgatcagggaaagttaccgatctgggaataaaggtaaactagcgctggtgcatgtggatgcagactggaattaccacaacaatgttggagaggacaaggaagttcgtttattgactgaagaggaatgggaacgttacaaagagctttgtaatatctccaaggtaattaaagacttgcaaaaataacgtaaaagccccttgacttcatggttgaggggctttatttttaggggagttaaataacctggagggtggtgtatgttagaggcaatcaattatttctttttagtgctggcggcagtgacatgtgtgtggtgtggctttggcgctgtcttttcaaaaaatgaaacacaccgcgcggtgtacgtggtttgtgcagtaatcaatgcttcctttacggtgcatatctggagtatcgccttatgaaaggtcacatgccttggattaaacccttggtgattgtcggaataattgttgttgcggtgtttattgttgttgacatcgcagataccgtcacccataattgtaagcctaacggtgaacaacgcctcgcaaacagtgctgatggagttgtcgttgagaacaaactgatctgcgacggtggtcgcgtgaagtggtctcgttactaaccctgaataaataatctcaagaggagattcaaatgaaaaaattaacgattgctctgctggctatggcttttgttgcaaccgcccatgcggaagaagatgatgatttccagaccgaacctatgtgcaaggttgaggtgtgcaacaagatcgagcgtttctctctgagcatttggtctcatatgaaggatagtatgggagagacctgtatcgacacggtgatccctaaaaaggatgctcaggtggggaatgttctgagcgaagagtctcgctggtatcaggggtcatctatcaacccaaccaaaaaatctgtgacccgtgtgtcacaagtctacaaatgtcagaaggggtgatcatgaaaaagattatccttgccaccctgctcgcgctttcttgctctgtacaagcaacagagttctataccgataccttggcaaaaaggatcacagatgcaggcaatgctgatatgctggatgcttacaaacagggtctggaaagagcaaaggctaagaaagatgcggcagaaattgaagtaaaaattgcagaattgcaagtggcagtttccaaaatggaaaagcagatgattatcctcacaaacgctgttgaagaaatggagaaaagcaaatgactatgactcgtggccttatcttcggaaaatttgcaccgctgaccaacgggcatgtcgcatttattcgccaggcggcttcgcaggtgagttgcctgtatctgttcctgtcgtatgaccagaaatttgttgacgcacaaccagagtggattcgtccaaagttgggtcttgctgatcgctatcgtgacttgctggatgttattgccgatgagggtctggataacgtgaaggttgactacgttgatgagtcgaatatacccggataccctgaaggaggtgctgcttatgcaaaactgatccgtgaaaagcaacctttcgttaaatacgactttgctttctcttctgagccggagtacgagtcttacttcagtgagttcttccctgaagcgaagcatgttgttatcgacgcagaacgtaaagctgttcctatctctgctacgatgattcgtaacgacccgtacaacaatttctataacctggcatggcctgcacgtaaacgcttcatgaaaaaggtcgccattgttggtgttgagagcactggtaaaacgaccctgacacaacacttggcacacacattcggtgcagcttggattcctgaaattggaagactgatctgtgagcgtgagtatcactccagtgagcttgcgatgagtcgtgaggattacctgcgtgttgcaatggagcatcgcctgaaggagatggaggtggctggttggggtgaccgtggggtaatgttctccgacaccacaaatctgatcacacacttctctggtgtttgtgcagataagatcgactactccgacctgttgttccggacactgagccgtgaagagagctacaacttctacgatctgttcctgttcctcacaccagaggttccgtgggttgctgatcctcttcgtttgcaggatacaccagaaaagcgtaaagaaacgcattctttgcttgacacaatgatcagggcatcttatgatacaagcaaggtggtggtcatctccggcaatgattacgaagagcgtactcaaaaagccgaagaagctgtccgtaaattgctgaatatcaaaggagaataagatgaacgtaactaattcaagcatgaagcaggcttttggtgttctgaaggttattttggaaaaggcccctgagttggctgaaggtcttcaggcttacgctaactgtcgtgagcaaggcttctctataaccaagtggaatcacaagtgtgataatgacctttcgaggcaagtttctttctccgagtgtcgtaacagtgatcagatcaatgtgtactggggccgaccaggaaacttcaactaccagacgaatgtgcctgacgacgacacgtatttttctcgtcgcaaatactttggttatgaggagtatgaagaagcggcagactggatcatcgcgtacctgaaaggtgacttagatggatcaaaataagcaggttttggtctggaaaacccaagaaggtaatcttgtccggatcacccatatgtctgacgagcatttacgtaatgcaatcatctggctactgacagactcttgtcttgatgacaaaacagaaggtgtgccgataactacgtgggtagaagcaatggctgtggagttaaacagccggatggttggtaatggctaaggttcttaacttttaccatattggtaaggttatccctgaaggtgcggtctacatgggccgcaccatgaagaaatttaacctggtgggtcataagctagccaacccattccctcttgagaaaggtggtgggaatcgtgatgaggtcatagaaaagtaccgtgggtggttgtgggagaagatccagaaaggtgaaattactttgcaagatcttcttgacttggacgggaaagaccttgtatgcttttgttcaccgaagagatgtcactgtgatgtaatcatggcggcaatagaatgggccaaggggagggttacaaaatgagtttgaaaaaagatcacacttatatcgagatatataagaacatcgctggaggtcactcccttgtgatctctgatgatgccggaggttatcgtctggcaggtacaaagataactggtcaaccgatagcgcgttttgaagtttctgttgaagaactgatgatcgcagtaaataatcaccaaggagaataacatggtttatggtaggggtataaacgactcagattctccctgtcagattttcaagtgggtagatggtagacaggttttggaatggagatgcccttactatgaactttggatagggatcttgtacagatgttattcaaagcagttccacaaaagacaacctacctatgccggatgccaagtggcggatgactggttaaggttttctgtcttcaaagagtgggtttctcaacaacccctgcacgaacagtggttgaataaggaaggtgatcttcaatttgacaaagacattcttttggaggggaacagaaattacactcctgaagcatgtgcgttcgttccaagatacataaataccgcattagcctatagtaagaacagcggcctacctatgggtgtaaccaaaaaagaaaacaggaaggtctatgaggcggggtgcagggtggacgggaaaagaaaatacttgggcgtgcgagcaaccccccttgctgctcatgcattatggcaaaagcaaaaggctgaaaatcttcaatctgtgatcgaggtatactcctcatctgaattttataatgagcttattgcgaaagccctgcaaaaaagagttgacagaatactaaatgacctccaaaatggagaggaaacaacttacttatgaggagaaaagattacatgatgaatctatacgtaaaaacaacctggaccgacttttatggttggtcgaaacttgaatatctgtggctgttcatctgttcagcctccatcgctctcgtgtcgatcatcatgggcggtggggttattgaatttatctcgtctgtgacaggtattatcggagcgatccttgttgcaaaaggtaaactttccagttattattggggctttgtggcgacagtgttgtacgcatacatctccttcacgtacaaactgtacggtgagacgattatgtacactctgctatttactccgatgcaggtgataggtgggattatctgggcgaaaaagctgactgtctctgaagacggtgaacgtgcggatgttatcaaaaagtacctcaccacaaagcagcggtggttggttgggattggaacgttggttgtgatcgccttgtatgcagaatttgtaagccttctgaaaggaagtatgcctggactggattccgcaacagcgatcctctctgttctggcaacctatctgatgatggtacgttatgcagaacagtggtacgtgtggatcattgtgaacgtagtcgcagtcactttgtggattcagacagcgctccaccatgaaactcaggggtgggcggtacttgcaatgtggatcactttcctgttaaactctatttatggtgcctacaaatggcgtaaaaacgaaggagctatgtaatgattggattttgggaatggttgacgatgcacaataactgggtgccgggtactgccctttatattacgatgtttgtttgggccactgtcttatctttcagggaaacatggaagtataaagttatggcatatttaatgctggttgtggtagttggtacgctatttaatgccttgtcaacttatagtgatggttatcgcatgtataaaaatcactggaccacttgtgcaaaacctgaagctgtggcatcattctatgtgttcgatgcacagaaagaacggtgctttaaaccagtagtggggtttgcaccagttgatgatatgcaggtgaagaccttaacaccaaaacaaatggagacaggcgaatggttatgaaatctgagcgaacaggtcaaaaatttgtagaaatgtacgaagccagtttaggtgagaatccaaatctggaagagcagttggtgctggaatacttcaagaagaatgttgaatatcttcctgtagattatgataatccaaccagtttccataaagccttccgtcaggtcgatgtctgcaagaagggttatcaagatatggtgatctggagcctgatgtctggtggtgaattgaacacaatctggtctgtactggaggagttttatgcgtaaattctttaagtggctactgagcctgtttagttcaaactctgtagtgaccattggcagtggtaacaccaccacagtgacccagacctcaactgtgcatgttctgaagggacgtgacccagagggggattataagtacaagcttaaacccctgactgaaaatgagatcagggatattgctaaaaaggcagtggcagatgtagcagctaaaaagctggtaacagagggccgagaagagcggctgaaagagataatggaagagttggatcgccagcgtaggaaccgtcgcccaccaccgcctcctgcacccccacgtcgccgtgtggttgtggatgatgattctctcgcacgacagagacgcagtgaaacgagttacagtcgtaacgatgacgatagcattgtaaccagcgcttttgttgcctctgctgtttatcactcgtcaagtagtgacgatggtggaagttatagcagtggcagttgtgactccggcagttcttcaggaggatgtgattgaaaataacaaaaacgtttgtttgtccaaacggtcattccactacctcagtcgtagagcactttgtatccacgattgactgtgccaaatgtggtgtaaaagccacatatgtaatggcactggaggatggtaatatggtcgcaggaacaacatcttgtagcttcccatcgtggatggatgatccttttattaaacctatcaatgtaaacaaggagtttatgtaatgaaatttttatctgcactggcgcttttattcatcgccttgaaactgtgcggggttattgcatggtcatggtggtgggtcttggcaccactctacttcccgttcgcgatttttgtggggatcataattttgtttttcgccagtgtctttggtgttgcaggggcggctgctcttctggagaaaatcaaattaagtaagaaaagatctcgataactattgacatacagagttgaaaggggtaatataccccttcactcacaaacggaggattgatgactgaggcagtaacccctatcgaaacccaatcagaaaaagaaaaactgttcttcctcgaactcgacgaaggtcagtttggaactgttgtttttctttccagtgccggagcacagatgaatcagttcatcggctcagagcgtatgcgtgatgagatgctgaaggttatccaaagcggcaacatcactactgtggaagaagctcttgcatgggtgcgtggacaccgcaataaccttctgcaattaaacggtgcatcgtcttttgccctgaatctactgagtcaggttgaagatctggtgatcgatagacttttgggtgttaacagtgatacccaacaagaagaaactaagtaataggagagagaatgagcgtaattaacgaatacaaagatccgatgtccggcaaggtaaaccacttcgcaaagggcagcatcaaattcatcagcatcaaacctgttaagaatgcagatcctgatggtgtgaaacgtacccatatcccagcgcgaaatggtcagcctgcaaaggttatcgaatcaacacataccatcagcttcttgatgcaagaggtggacgacaataacaacgttattgatcctcaaagccagggtgagtggatcggcatgggggagaagaagctacatgcaagccacaccgacaaagtgcaggttaagctggactctggttacaaagacattctgcctggtatggttgcatctttcccgctgaaagtgagcacgaacggcgataagacctatgtcaacggctctctgagtggcaagactttcaacattctggacgaaagcaaagcaggtcaacctgcaccacgtcagcagccgcagcaaagtgctcaaggtcaacagtctggtggtggggtgaaagtttacggcgagatcaccgctattgcagggaatctggcgactgtaaatgatgagaagaacggccctggtaatgttgttctgtctgatgagcaactggcacaggtacaggttggtggtcgcctgacagcttttgtaaatcttgctgatggcacaatcctgaacggctttaaagcttacggcccagtaggtcaaggaactggctcaggtggtaagaagtctggtgggaattatgaccctattggtgtagcttgtggtcacggtatcaacggccttaaggaattgatgggtgcaggttacaaagtgaaggatgaactggaaacagtaaaagccattcaccgtgcaactgtagacatgaaggctttcgttgcggagcgtactggtaaggatgttgaatcaaacgctgttggagcaagtgcaggtaatgcaatccttgttgcatgtagccgattcaatgccaaatcggaagtaactgaggcaacgatcctggaaagcgccaagaacgtgtatgtaacgctctctgagccgttttatgagttcttgactaacgatggtaagcctgcggatcaaacccaaccacagacttctcaggagcctctgagcggcactgttgatgtaccacctatggatgcttatgagcctccgatggactttgacgacgatataccctttgccccaatcggtctgcaatatggtagaaacttcatccattgcatttaataaaaagaaaaggagcctttcggctcctttttgttttattgcggttgagaaggtacaactggttcgccggggtccacaggatctggtggggctgtgaagtctgaaacactgacatacgaatcatcaaatgcctcaacctgaccctccctgtaaataagacgaacaccacaacgggcatcaccaactgcaatacaggaaaggaatccaccctcatcaatcatcaccacatccggatttgtagttgttaattctccgtctatgaagttagtatcaacattggctggagaaatttccattccgacaacgttcggacctggtgtatagtcaggactgtttttatccatgaacacgaacacatcaccaacttccttttgtgggatggaatcggtagtcacagagaagatggaaacataaccgccagaagtatctgtgagtgttttagcatccgcgccagaccctgttttagcagtcattgtgatgtcaaaaccaccctcttcaaggaaggtcatgataccatttgagtctacagttgcgatattaggagcactcgatgtgaacgaaatatcataaatctcagcatctgctggctcaacagtccacgtaagttgacttctcgaccctttgatagcgtatgggatagaccctgtggtgatagcatccgcagttgtccccccaaaggatgcttctgggatgtttgtgaactcaccagtgctatcggttgacccaaagaaaccataaaggttaccagcgtagtaaaggttcccgtcatacaccatccaatggctgatagagttcccctggttaaggacatctgtcttcatgtctacaatgtatgtcagcttcgaaagatcccaatcccttcctgtaggaactggaacaagggtcggttctaacaccattgttgatggtgtgccaaggccaagttgagcacttaggtcaccaagaccgtaaagcttgttatcagcaatcaggaaatgagactgaccaccgtcgataaccctgaatgtctcgaaaggaccaataccctctttcttagagtattgggctgtcccgatacccctcgtatataaataatgctctgtatcatcaacacctgtagaggcgatagccattgagtttgtttcgttcgctaaccactctttaacatagacggtttcagtcacagaggcaaaactaacatcgataaagttttgtgtttgtgttgttgaagtaccatctatctgatgggtggccccacaaacacggggaagtccaatattgttcaggtatgtcacgcaagcatttaagctgtaagctctcacagaggatgcactaatacttcttgggatcgatattacggtagtattaccagagccaaggcatccatttgtgtttgacccgcttccataaagtcttccatctaccatctgccagagtgtgttaccgagagcacaagaaacactttgtaaatttgcgagggatactgtgcctgtgattgatgaagggaagcttgtccaagaagaatagatagacccactaccagtgaattgactggtgtccccacaatactgccagccaccattgttgtatttgacaacaaaggctctaccaccaccaaaaacatcagctacaccattagccgccaagtgccaatgatccttaaacgggcttatgttcccgtttgcgcattcagaccacgcattatccccttgggtatagagtctcccatcaatcaggaggatcgccattgaccttttggtagcaccaccaaccagaccacgggtaaaggccaccttcttaacactacctggtggtagtggttctgttcctcctccagataatgtcaagaagagacatggaataggatacattaaaacctcctaaaagaaaggctgtccgaagacagccttgaatcattacggacgacgaacaattacagtgtcgataacaccgccttcaacaccattataggttaattgaagaatagtcaccgaaccagccgtctcgttaattgtttcgctgtttaaaaccaagtagttaggatctaaagtcacagtgtgaccgccagtaccatcttgagtcaggtaaatcacagcagaaaaagcatctgtcggttcaggccaagcaccaattgttaaatccgcatccactgttacgttgtagatgttggaatctccacttggggaccatgccgctgtagagctatcaatatcctcagcaataagtgtcaggaattcaacacttgccttggttaagattgccgaatcctgtaccgtaaggctattggcagttactgcaccagtagaggaaagagatcctacgttgatgttctgacctgtcaagtcaacagaaagacctgtaaccgtaccctgaataacaaggttgttaactgtcgttgttcctgttgcgttgttaaggttgacatcaccgtttacggtcaggttatcctggactgtaacatcggcaagtacgctaagatcctcaataaactcagacgttcctgtaacagagagttttccgccaattgtaccatctgctgttccggttgtaaatccaccattgagactggttaacccacccactgtgaatggaccagtgatgtttccgttacccgcagagaaatcttcgagtgttgtattaccgtttacggtcagatcacttgtaatatcaaggccaccgattgttgcgtttccaaggttggtaacaccactgacctgtaagtcaccacctacagttacaccgtctgcggttgtaacagagtttggtgaaatatcaagtccgttgacactgaaggtgatacctgttacgttacctgtaatattcaggttttctacctcagttgtacctgagacctttaatctcggtgctgtaggatctttacttgcgttaccacggatatacacataatcgaagacgttattacccacacctgtcagagacatggttgtatcatcttcagccactgttccgttgacaataatgtccgtctggatgctgtgggtttggatcgcatatgggtcaaggcgcgtcttaaagaatgtcggattatctgcgtctgtaaatacgaaggtaagacttgacaactcttttgtcaggatcaggttctggaaacgacctgttgagttatctgcgtttacagggccattaaggtcgattgtcccaccaaccaccaaactattgagtgttgtagcacctgttacagacaggtttgcaaaggtaacactaccacctgagatgcttgacaaggcgcttgcaatagcggttgtaacaaaggcagttgtggcaattgttgtactgttgctgttagccgcaggggttggagcctgtgggtttcctgtcaggatcgggctgttgattggtgcatagatagatgccatcgccgctgcgtcgttgtacaatctccagttaacactgttagctgggttttgtggtaaaacgacaggggcgcttgctgttgcggttggtgcataccaccattgaaccccatttgtgccattaaaagcataaagctggttgaatactgtggtctgagtacccgcgatccacggcataggcggtgttttaaagaacaggttgtcaagaagagctttacgaaccgttggaatggtgctaccatcttcagtaacaacagtttcggatgccgttccgttgacaaccttgtggaggcgttcagagtcttcaacaacctgatcgacagcctgttcaaattgagtcatgtctgccacaagagtctccttattggtctgactttggttctgtacgttgggcttctgttactccccagcgtagagatattagcttactgattagttgaggtgcagcaactgtgggtgcataaatccacatgtaccactcggtcaacgttccattgaatccccagtaaaggaaaactgcggtcattgaagccaagccgatattgctccaaaactttgtgtgagaaaccctctcagggtctactggtgatctcacaagatctttaataaatttcaatagtgattttaacatatttcctcaagattctcaatgaactaacatgggtaggaaccttgcaagaaccacgaggcttaccacagtagcagtttttagccactctttaaccgtattgtctttaaatgatgcacagaggatcaatacttccataacggtctgatatgaagatttgatgacaaaactcaatgcaagtggcaaaagatatggaaattgcatgactattatctggcagaagagtacaggcactgatacggaaagcatcagcttcttcttccatcccgacaatacacacgctgtggcgaacaggagggttatgtcgagcaaccaacataatgacatatatagagacaggtcaaagaactggatatgaactgaaaaccaccagtacagaatgttctccagaaggatatggatcataccaaaaatagacatgatccttatacccttgtctgcattaagcagcagcactgcaaagcataagaaatacagtgctgaacttatcatcgacgttgattctccatgagtagcttgaactgattgctgaggtcagcacgaagatcgcccacgtcttctttaatgtccttacgcaagtctgaaacgtcatcacgaaccgttttgagtttcttatccagaatctcgtcaagtttttccttagtgaccatctctgccttaatccttatgatgtctctatcaagttcatcaaggcgctcttgcgtttttttgtaatctgagtatgtgattctcaggacaccaattaaaacaaacgtgataacgccccaaacagctttgaggatagcaaataagtcaatagacattatagaatccttttgctcttggctggtctttcaggccacttgatattaggagcatcctccgggtctattgctaaaagatcaatacggtatgtctttagcttttcgagatacgctttctgggaatccaaagtaggtcctctggaaatcaaatcttcaagggctaaaatctggtttgtagcccaagacatttcactgtccagaagaacttcggcctgtgcaatagcctctttattgtaagctttaaactccccagagatgaattgcacagcccctaaacgggattcaataccatcaggaacttcatcaacaacagcaaccttcatttggtctgggaagtatgctgatggatcagaagacacacacaacacgacatcaccggaagacagaagaaggaacttggtcccctctttcaattttgtcaactctttcactatgtcgtaccaatcttccccgtctttatctttcaggaaaactgcacctgactccaggaatgcggcgttctcgtccgtctttgttggggtgtataatgaaaattcaccatatacctttgtcataaatcctccttagtccaggttggaaacagttacccattgtccgttaatgagatactgtagtggtgcagtgtagtaagttgcgcccctcaattctttcttgttaccgaaagcccacccggtcatgacgtgacctgcataaaatctggattcacttacacctgtggcaaacctattacctaaacggatctgctgaacaaatccagacaggtttagtgtgacgttaccgttaccatctgccgttgcaccattgattgctctcacaacgtttcgtccaccaactgtagcggagttgttgttgacaacaagggagttaacgttacactgtccgtttacactggcatatggggttgttaaagagcttgttgcgacaacgttgaacccttgaacgtttcctgttgccgttaaggtccctgtcctgattgttgtggactgaatagttggagcattcagcgtaccgcttacggtagtgtttgtgaagtttgcagtggttgcagtgacgcttgcaccgcttatacttccgcttgcgataatgttaccagttaccctacacagtgcagcagtgccactgatcgcattcaactccatcattgtgaagattgagccaccagaagggacgaagcggaaacgcatactatcgatgctcgacgtacctggggcattaccgatattatcaccaactacaaaatcaaagaatgtggtgtctgctgctgggttggtggtcgtgatgtatgcgtaatctgattcggatggttggaggttcaggcgtggaacagataatgcaccagtcatggtgtcgcctgaaatgttcacatatctggtatcagactctgttttactccaaacatcgaggtttgttcttgctgcggccttgtctgcaaggtctgcaaggttctgattcacacgtaagaaacgactgtcgagaccagggatctgctcaccagtgatatacttggcccatgcagtcagcatatttaaaacgtagttaaattcttcgactgttggcttttcaccaaggtcccaacctttgttccacaggtcatcgataggacgtgctttgtttaattcatgggtgttaggaagaacaatatctccataagcccaaatctcaataggtactgttggcgctgccattgtaatctcccttaaatcaaggtattctcttcatcagacacatacgtcaggtgagcaagaccaccctctcctgttcggcttcctgagtggatagaaccgaatccgagtgcatgtttatcgcctgcgaatccaaaagccgtaccagttgactctgttagtctcaggtgtgttggcataggcaacatgtcttgaatctcctggagagcagtctccaattcgaaacatgttttggaaatgttaatatcgaaacggtagttatcacccttgtatgtggtaaagttaccttccccgaacaactggttaagggtatcgataacttcaggtcttgtcccgtgcttcgcagcacttgccaaaaggatgataatgatggcacgatagttcatatcgctcaagccatcacgctcaatcccgacctgcttccctatctcatcaaggttgacacctgtcgcatttttcagtaatctgccctcagacaagttgacccacatttcatcaagctttttgaggcgttccagataaaccgtcataaatttgacaaggttttctttctctttcagaaaatcgccagggaggtattgaatacctccctcaacgaaatctggcagagtatggatgtggttgacatcctttaaatagtctgccatacttacctcattagatgatttgctggaatgtaatgtcgtctgtatctaaagcaaagacttctgtcatacctgcaacaacatcgctgttagtataagcactgtcaggttggtcagtgttcttaacatccaccaacaattgcgtgaagcgccctggtgaaatagaggaaccaactgcggataccaactggatgttgtaaagtgtatctgcaatgttgagaggatcaacaacggctttcaatgcatctttgatagtgttttgctctgtcacggacaggagctttcctttataacgaacacggactgcaagctcacgagcctgtgctttgctgtgatagatacgttccgtctgatcatcctctgtggtaacatcataaaaaacattaccataggttgcgttggacaatgcgattgtgttataaagtgcttcactgatttcttctgtggaaccaccataaactacagtctcaaacttatatgccggaacaccaaactggtctgtttcccctgtgttgtttgagaatacacgaaccttgctgacgccctcgacgtttaaaacggcagaaataacggcaggtctagtggcagcagcacctgctgcggtgctttgtgaagcacgaaccttgtaatcagtgtctgtctcaacatcggaaccgtcattaaaggcggtcatgttggtcatgctgataaaaccgcttggtgtcggtgtgatattcgttacagtatttgcttcacgagaaatagcccctgcttcagcagcaattacttcaatggtaattgttctctggcccactacgggtgatgaacggaaatcaacacgactgttaagtccgatcattttcttgttagcatcatacccgatatacatcgctccacccgcagagtcaatgaagatcctgtcttcgtttaactgtgtggagttgtcaacaatgaaatccttaatcgatgacatgaacgcatttaactgagggctgttaggcaccttattacttagcgtcaagttcattgattttgttgaaccatcgttctgattaatcatctggaacgtatagttaccaagaacccaatcttggttaaggatttgttgcgccaggatattccctgcgacaggagtgtcctgcgtgagtacgaagttaccactgtcaatgctatatgttgaagaactgtaaatcatgttgtacgggacggtgttgttaacaaccatctggatagtacctgatcctctggttttaccacgacgataaataccacgacgaccaagcagttcatcaagataaataccttctgcccctgcaagtgtctgtgcagaatacacagccgcagccagaaggatcaactgatattctctttcattcaaaattgtggtaagtttgtcaacaacagtgttagcctgagtgttgaagttttcaccaaaagttcggatcagcgactgcttggtatctgcgattaaatcatcgagggatgggatcgcaaagccgtagtcatttaatccatattgagcagccacgaacgcctcctcttgctagatttttgctctaagatgttgctattttatcatattgtgatttaattataaaggcttataataagaaaaggggccgaagccccttgttatttaagtcctttcgctgtatactacgggatttgtcgaaacaagagccgtgttatcaggtgtggctgtctggattggatctgcaatgtccagatagaacggtgtgatccaagcacctttttgatatggcgctcttataaccgttgtctggagatccgcaccaccggggcctgcgcctgggatggtgagttgcaacccagcagatttaaatgcacgagtagcccaaggttgtcggatacttgaatctgctgcacactcaatcgtttttgagccaaccacagttgccttgatgaaatcattaggttcaatgtaagaaccccctgtctcaacaacaaacataccaccagtcttcttcagaatgatgtcccctttaacgaattcctttccttgaggaaaatcatcattatcagagatatagatgttaccagcattaagcagtatgacacctctgtttccgtttgtctttgagtgctgaaccacatcgaagttacaaccgtatgttgttaagtggtcaaagcctacctgaccgaacttaccgttagcgacaccattatcatcaaggctattgatattaatgatctcagcagaacaccaagcccaacgcttcatcgccccgcctgcctcaccctgtccagcctcatagtcgccaataccatcaaactgtttacagcggatgtcagcaagacgaagttttgagacaagaccgcgatatttgaaagtgtggcactcaatgtcctcaaccttcacatcgttggtccagtcatccatagcactaactggaatatctaccagtcccgtatgagtacgtacatttcgcagtgtaaagtcacggcacggagcagcaaaggttccttggttaacaccccacccaaaataaatgaatcgggtagcaccgttgaccatttcgccacgaacaccatcaatgatatagtctttgcaaccataacatacgacaccaccggatgccagcagtgttccgttagaaacggatgcatcaggataaacctcaacgttctcgaccttaaagtcacggcaaagctcgaagtggatacattgacgaactcgacgcatcttaacgttacgaatgatgatcccactaacatattggtcatcagaggcgttagcaccatacggtccctgccccgcaacaccgataccaataccccagttaggagagttatctgtattgttgatgttgtcgatgttaatatcttcgattgtcaaaccacccgctttatagtgtctctgtacaacgttacactcaatagcatcgcctgtcaaatcgttaaagttgagacgggcaaaacgtgcgcgagtaacaagagcgcctgtaccttgctgaaggataccatatttacaacctctgaaatcactatccagaatgtcaattgtaccttctatagggagggcttgtagtaacatcgctgcggtgttggtattgttaacccatgaggagtctgtaatgatcagacgcccaccataatggcgagtacaaacacctgtgaaggtcacccagcggaatgtgctgtttgataaatacatgtatctgttgccgccagtctggttaaagcttccaccataccattcaacaccgtcgatatacacacttgtctcaagaacaaggttccatccccatgcaagaacagcttttttgttctcttttgcgtatgcagctaacgctgttacagcctctgtcgttgttggatatttccccatgaattgtgcaggggtaacaaaaccatcgagtgattgagccactgttcccgctggtccaccgataaaggttgagccattagcacctgcaaggtctccacgtagagatgggtcgttagctgaccacgccccttcaccaacaccacctgtagtctccggtgtggagtcggcaggaacaagtttcgggtatgcccctgtccattgatagatcctgttggttgatctgtcgatcacctgatctttgggggagacaagcgtccccccttcttggaaggaaaacaggcgcatcaacccgaaacgggagaacatatctgaccatgttgatttacgggttgcatccgactggtcaacaaccaggtagtctccctcgaaagattccgtcgcattcggtaaatctgaaatcttgacggtaggtaatagatctgccattaattcctcttatcttgtaaggtttctgtacatagcgtacagtccaaaacctcttaacaattctccagcatggaagccaaagaacatcccattgtctgtatctgcacgaggagcaacagaccaacttccgttcatagggtgattaggggtcaggacgatgtagttttcctggatcaggtcaaaacaacgctctgccacaaggtcgatgtttggaatccttgtacccattcccgccattcctaacatggcgcaaccacccataaacaatgcagacatatgacttgtgaagtcatcaacaggagcaagaacagtgccatctggattaaagatggtcggagtccttccttcgttgttgtcttggaaccatttaaggtaatccacccagtttttggcaaccgtgaacaacttacttggaatagcctctttgcgttgagataattcataaatacaacggcaaacgcagaagaatgcacgagcttcataaccatcccaagccttctcattccaatgcttcattgtgaaggtgtttggttcaccatatttacgagcatcccatctatcccatacaaaagcctgagccataggacctggcatcacagggtggaatgtgttgtaaaaccacatctgtgagtcataaaggaagtcaatagtattgttcaatctcgtccagtcaatagccagatccttaaagcaatacagggtagggtattgataccccggatatggtaatcctcgccacccatcgtatagtgcagtgttcggatcactgatgtttgagaacggtatcagtccaggggtatagttcagactgttagtcctgtagtcaataattgtacaatcaccaagttttgcattgtacggattatcaccggaaacagtaatacgaaaatacatagtataatcgtcaccattgtttgaggtatacagttcagggacagcgttgacacaataccaatcaatctttgcacttaccccatcaaccggatcggtgtctggagctaagtttatctgtttcagcccatgaagattaatgtttgttggtcttggatcggtgtctgggtgatccggttgataactgctcaaagcaaagcttgcagtgttcaactgtagggttgtccattcaccattcgtagcaggcaataaagcccaccatctccactggttatcatctgtgattgaaatattgaaatcatcggcatacgagcgataagtaaacgcattcagatccgtagtctctgtatctgttaaccaaaatccaatagtgcaaccaccatccgcatctgtgataagtgtacaagcctgatcgttgatcctaccaagaatacctgtttggtattgaaagtcaacggttgtgttcgttccccaatcgacaacgattcgtggatcagccactatgtagttgccaccacctggtggggtcaacctgacgaaattggacagtggcacatccatagacacaatagagtctgtgcctcttggtaagccgcaacgataagttacacgaccttcctccgtcttcgttttgttcaggtcaagttctggtctgaataacaacccattgccaagatcgtccttacctgcaaactgcacacgtaattttgagtctccattaacacggaaccagatagcctgctgttcaagcgttgtctgtgctgccacattttgacgaataccaatataaccctcagagtctctggtgtatacagggactgctgaagatgggtatgagtaatcataactgatcccatcggtgaaagggattattgcaaatgttgatttgcggaagaacttatcaaagcggtcaatatcggaataattgtcacaaacaatcagagaagattgccagcacagccaatactttcgttcaccagtgatctgatacataacatagttggcatcacaccaccaagtttcagcatcagaggcgttgtcctgaaatcccatctcaataggtacgttgactggtcggttatgccacatcgtgttccgatccatcaagtacccaccatgctctacagggttgcaagttgcatagttgaatttgaaatttcctgttaccgtggtatctttgagttgaacagtcccccactccgcctctgggaaaccctcttcaagaatattaccgtcccaatcaacttttctgccgagtctgtcaatgatccaatcgacatcccactgagacccatactgatcccaatttgtcgtaccatctgcgttagcagcatatactgtggcgttaacggaattccatccaagattaccatcaaaggcgaaccaagccttgtcaaggtattctccccaatgtggagcaccatgaggaattaacgtcttaccatttgtccatgacataacgctacccttaaacccaccgtgggttgggtatccatcgtctgtcagtgggtaatgtgcaagccttggctctttcccgttaatgatccagttcgggcgatacactgccggaggatctgggattggctgaccagcaaagaaccagtcgatatatgcttgccaaaaatcttctgcaagttccagatatttagggtcgttggttgcaagatatgcatatgcgcaaccgaggatcaagacagactgaccctcggtagttgcatcaccgttaggctgggcttcttgagccgtccagttgataaagtgacggttgttagccaaaacattctgtaagttcaggatgtagtgctgaactgtcgggtcaatggtctctcccttgtttctttcaaggaactgtatgtgaccatcgatcaattgaaaaacattatcaatgttgtggcgtaactgtgccattactcaactcctgccataataagggagccgaaccaactattcccaccatcataagtgacgaactgaaagatgtctcggaccccggttttataagaaagaactggaacacgcccataattccacttaatattactgggccatgaaaccaaattcgcccctgtaccctgtgttaaggataaggtaaacgactgagatacatcctgagccgttgatggattggtaattatgacaacgcactgaccacctgtcaagttggcaacaaaagaatcacccctgttaaggttacatgttgctgtcccttggacattgccaagattgacaaccttacctgttgaaccgccgccaccactggcaccgaactcttgccaggcgttctcactgatgccgcctgtggttgacggggaagatgacattggaattgttttcgggtaaacaccattccatgtgtaatacttaccattcgtatcaaagaatgcaaggtctttcttggattcaaggaacccaccctcagaaaagaagacaaccttcataatacccatacgagtcatgatggtgtcaagagaagccttcctggttgtgtctgcctgatccataactacatagtcaccaccagatacggtgacggcggaaggaaggtcagagaccttcaccgttggaaaagaaacatctgccattattcaccccttagtggttacggttgatggacttgccatcctctgtggtgatgatattattcttatcatcaagtaaactaccaaccggaattgggttatccatatcagcaccagaccaagtattccaccatgtagcatcgccagtgcgaggaagacggaagttgatcaagtaataaagtttgttagcccaggtgatccaaccatcgtcatcacaaagaacggttgcaccttcatcaggggttgggtaataatactcgtcttgacctacaaaagcgagtcttaccacttcctgttctttggttgtgacttcataaaaggcttgataactacgggttgttctatccatagttgaatagaaagaggtgatttcaagaacgtcaggttcaagacgtgttacctccttgatcttattgtcaaggacagtcttcattacttttttgcttaaatatgctcggtatgggaaaccaaatgtctcatcgaaataccagttaccagcccaaatgttgaatcttagccacaggcgctgacgaaggctggtctggtttgactcgataagcttaagccccgaggagacatcaaggtctcctgtaactgggtccataaggagatctgagtaaagagttgccatttaaacctcttatttgttgggtgggttggtattaccagaaccaccatcatctgtccatgtgtagaagtgattatgacggacaaaccaatcatagaaatcattcatattcacaccacgggctgtaataaagttgccatctggtgtgacttttgccccgttcatttcaatgttcccatccacctttgcagtcagtgttgctgcaccattggtgaaggacatttgaccagttttatcaacaatgaacgttccaaccggaccagttaatgtgaaatcaccttcaggcgtcatggagaagtgaacttggtcgttccacaactcaacattgtttgggtctatagtcatggcgttgccatcactatgaacaccgataatggaccaccctggaaaaagtccgtgggtggtcgtatcattagcgtcaccttcattgcgctcagagaaggagagaccaacaacgtcaccaggcttcacaggaagcgtcaggcgagcttttcctccattagctgaaggcatggatagcgggacatcgaaaaccgcaggatatgcgtctacggtgccatcgtcgaagtttgttgaggctaagggttggacagtggcagaagggattgcgtaatccacatcaaccactcttgcccttagtcctgtgtggatgtcgcgagcttgccttgcgaaccattggttaagcgcagcatccatacgttgaattgatgccattattcctccactactccaccacgggtttctgcaagaccgatctcagacacccaatcaccaccctcaagttgccctttgtgggtcaggtacacaactttataaaaccctgtgtatttctgacttttcaggtaaatcgtgctttcaggaatgatcgcaccattaagctctgtcaccacaacaagacctgcgtcttctctgatctcggcacgacttggacctttgttggtttttggtttctttttggatttacttttcttttccagcctacgctttgctggttcagggttttgcggggttggtgaatcatgcatacctgactctgcactgatctcaaaaacagccgtcttaaacctcttgccttgtgttgtccagtaaactgcaccatcttgaacactgaatgttgatccagtattcttcgccagcctttcaagattgttcgcagcgttacctgtgaaagccattgactgctggagagtctgaccaccgaacttaacaaccttcccaattggtaatttcaagtctgagataaggtcgttaagaactgtatcaagaggagtccccttcttataagacctagcggtctttgcagtcataatgttggtcgttgcatcacccaggatcatctttgtttgtctggtgtgtccatcccatttatcctggacaaactcaacagtccctgaaaaaatcatctggttttcaccatcaaaccccgcctcaagaacaatggcaatagactctctctggttagcatcaagataactaactgtttcgtcactcaggttataaagcgtgacataacctttattcgggtctttggagttatccttcttcacctcaaactcgatgtttgcagcgcctgtttcgttactgacaacatacgcgttttttgtatcttggttggtataatcagagatgttcgttggtttctgtccaatataaacaggtttgccaatggtgagtctgaatgtacgtgttctgtaagtcggcatctgttaatcctcgtcttcagttacctcgtcgtcaggagatgaataaaggagttgcaagtcagacaagaacccgatattgtatctccccacacgtttggttgactgggtgaatgaaaagacacgcagttgccctgaaggaatgttttccaaatatttaaaaggggcaaagatgtcgaaaattgttgttaatttgaaagagatggttggatcagagccaacatccccaaatgaaacgagccaagattcatctctctcgttccactggaatctcatctcgtatgtttgactgtccaataccacacgcatagtttggtcagcaaaaccatcaatatcccatgagaatgtgatctttgacattatttacctaccgccttatcgtaatcaataatggagccttctggagtcctaatcttaccatctggggtcatcacaccaacaacttggtcttgcttggtaaagtttccagtatccattgaatcagcaattgcttgccatccatctttgtttgggccagcaaatttggttcgacgagcagtgacttcaacctcattgtcggtagctgaagactgcacagaccctttctgcttggttttaccaccagactttttagggtccgaatagattgtcgccatcgcagttttgccaaggatgaaggtgcggaactccgtgaactcaagctggaaaaccaatgcagcgccatcagagttgctacgagaagcctccatcgaggttaaaatgtaattctcgatgatcttatcttcagtcaccaaggtaacgatctgacgatcagtgataagtctttcgaggacctcaagtgccttttctgggcggcgtgaggcaaccgggttttgatcgtctgtatctttatcaatgtagttgttttggataagataaacaggagatgagttcacccttgcactgaaagaaaatttcccatcttcgatgacaccgtggtcactgaactttaccttttcttcaacagcgtaggatgtcttatcgaccgtccttgtgtaagagtgttgttcaacaacgtcgaaaatgatcgcgaggtcgttggtgtagttcttgtccttgagttctacgtttctaccgccgtagttcaaaccactggcgaagagcgtatattgcacctcaccgctggcttcttgggctgtgttgacctttttctcgacgttagccgtggccttaccctgttgcggtttggactggttgttggatacaaatgccatgagtcctcccattatacatgttacgattttatcataaatcttgagataaaacaataaaaaaggggccgaagcccctttaaattattgcgggacaccaaggattaagttgatgttccccatgtttgcagcttcgatctgctggtcgatcatgttcttcatctcacctgcatcaatcttgattgtgatctctccattgacaggttcggttggaatgaccataggagcatttcctgtcgggccagcaccaggcatcatcgagttctggttcaggtagttgagtctattctgatcagtcattgccctctgaccagtaataaagtcccaagttttacccatccacgagttcttgtaaagattaccacctgcggttgtatctgtgccgtatgttgattcactgtaatcttgagcttggtcgaagacataatccccggcaagcatactttctccagcaatcaacccatacagaccaagccaacgtgcagctttacccatcttaccgaagcgtggaccatttcttttcttcttaccgccgccctcgccaccttcatcatccccaccaccgaagatcgttgttaggaattttaaagctccggagagtccagcaatcttcgaaagaataccgaacacacggatcagagcagaagcaaagaacagagcaccaacaccccaccctacccatttccatgcagaggataactcctcgccattcttacggaagatcggaatgtaacgttccatgatgccttggatcagcacaaaggtattgtaaacggtatagaccatctccatgaacccggcagtgaacccagcaacgaattgacccagattttgagccaactccccgttggagtcaaggatttttgcaagttcgttgaacgcgcttgttaactcatccccaaatccgctctggaaaaccttgttctgaaagtccatccatgttaaggtcagtctctgcatcgcaacacggttgccctgcaatgccttttgtaaagcaccacctttatttgcagcctcggagtaatacttggctacaaaaggtaggaccttcgcagctttcaactcgcccttctgcatcatatcgagcatcttggttacgtcgatggtggaatcattgaaagcctcttgggaagccttgatgaacacctgtaaagatcccggaataccttcagcaagttgctgcttcagttcttccgccatgatctgtcctttacccatcatctgctggattgcggtaataccacgttggtatttgaccggatcaacctgtaaggcagtagagtattcagagaacgccttgaaaagttcatcgttctgtgatttactaagaacaccatccgctgcgattgccatttgggtgtaaccctgcgatgcaatcttgaggtcaagacccaagcggtaagactggtcacgaacaaacttcatgcgtttcccagcttcttcggagctatcagaaaccattagcatggtggcttccatgccctggaagaactgaccagctttaacaacgcttgcagcggcattgaatgcaccgtatgctgcgctaacgctgattaaagtgctacgaaggtttttcaacccgtctgtcagggtaagtgtactcgcatttgccttcttgagtccagtctccattgctgcaagttcagcacggaaatttgaagacttcatagtattactgtcaaggaagcgctctttcagagaatcgtaacctttcagttttgaggcataattgtcaccatatttagcacggaggcgaacacctgcgtttgcaaccgtagattccttacctgcaagataacgggaataacgctgatcctcagcttccattttcttacgggcctgctcacggacgcggagttgctctttggtgacttccttttcaactcttgttccacgttgcatctgacgaacctgtgcagcgtgtagttctgggtcgtaaactttgtttgggtcaccaaccatgcctgtagcatttccggcgttcgagcgttttgatagttgctcttggagagcggcttgacgtgcagcggaaattgctggatttgtgccgtaaccaccacctgtcttttccatctcacggagacgagcctttaggccattgtaatccgcttgagattctggagatctttttgcggtcagttgaccaacagcctgctttctacgggccttttgaattttgtcgattgcttcacgggcgcgagcttctttcttagccattgcaatagcatgggctgtagttttcgcttgctctgcacgttccgtttgttgtaatcttttgttgacaagacgtgcctgcattgcagaacgtcttaatgttgctgctggatcagtcttactggaagagaacgccctgccagctttttcccattcactcttcaaagacttcacagctttcatggcacgaccgaaagaagtcctgtccacgtcccatgtgactttgttgactgtctgggttacgataatattcgccattgattccctctcaataaaaaagccaggctcccgaaaaggaacccggcttgagattaacctcttctaccacggcgcggcctgtttgcagcttgattagcccttgctttactttcttcctctctttcgtggacatcagaaacgaattcttccacatcgaggtattcattcagcttgagcagataggccatatcagcagattcaagggagctataggattcccccttgaagtttttcagagcacgacaccataagtaatcgaaccaagtcagtgagctatttttctttgcataatccatagctctcaggacgactttcgaaattttggacggtgttactccgctgccacttccattgcctgatccaccgagttcacttgatgggtctgtcccaggcgtcccagaagtccctgaaggtctgcgaaaccgtctttcgtgaaaaaacagccgtagttaatctccagaactttagcaaccagcttgatgaggtctaacattttgtcttggaacagagcgtcaatatctactttacccgccataccatcaacggatacatcttcaagaatcaatgcgaaaagtttttcgagatcatcttgctccatctgttcaaagaggtatagaatagctgtagggagggcatcagaaaggttctggcctccagtcatcatggaaccagaaatggttgccattgggactgctacataacgaccgatcttcggaaggtttttcatgaccttcgttggagaccagtgcgtgataatgaagttgtgacctgcgaggtcgatttcagttgtcggtctgatattcatgtacgctcctgcgtctttgtggttgagttatccatgcgtgtataaaggccacgtccatgtggcacacgaaacacttaaacgataccagtcaggccagcaagaccgaagcctgcggaagacagagtatctgggcttaaccaagcatcaaggataccgatttcccagtccatctggcccacttctgttccgtaggtcaggtctggttgtttctgaatccaaccgatggtgctgagtcccataccctgagaaccttcaagaaggacagggaagaaaatcagtccggtgatagaggcttgtttctgccagtttgcaaagtttccgttccaagaagcagtgttctgaagggaaaccgtcatgacaccagattggttacgtgacagtgcggcggataactcaccatcaacccccatgtgggggatgatgttatcttcgttacgggcaacgacgattttagtatctgcggcgaaaccagtcacacgctgggtcatcaggtacagtttgacttttttagggtcatacgcatacggcgttaggatagctgtatccatttattacactcctgctgttacagtctgaccgtttccggaattagaccctgttttatctaacagaacggtcatgcggatcttaacgaagtgcagtggcgtgttgtacacaagctccactttcacgttgttcagagtacgagcagccagatcgttagtcgggatgttcgcacgaagcgggattgtgatcaccggatcgtagaacactttgttaacgtcatcgtatccagtaaggatagacccgtttgcaataccaacgttgatcgggttgttcatcatgacagatttcaggttaggaagatcgtcatcactcatcttcatggagagacccatgttagaacggcgagacatgtatccaaacacactttcttctgtacggaatttcagccagtgaccgaaacgaacaacgtcaacgtagttaccagaagcacacttaccttcgtagaaggaaccaacaccgttaatcatacggtagaagttcagattctggtcccaaatggtcatgcgatcactcacactcagagttggagcgataacaccttccattgtcttcaggtggattgagtcaccataagaagggtcgttggaagccattgcaccgataattccaccctctgggaatgcgctatcagcaagaggatcgtacatgccgatggtagtatcgtactggagtgctttcagttggttagcaatggagttgctaccagcagtcttaaccagttcgtcagcagttgaataaacgtgcagcttgtagtttgcagcagcgaaagcagcagcaccaaggattgaagcgttggtgtgagattcagtgctcaggaagtaccagttctcagttgcagtcaggacttgtggcagaacagacgacacagtttcacttgaggagtttgtgattgtcatgttaccgctgtcacgaccaatactgaaagtaccatcatcttttggagcgatggttacaacgcctgcgcttgccgtagcagtcagaacagttgtcagagttgcatcaccattaagggctgctgccagggcagttgccagagagcttggggtagatgcaccagtcactgaaagaataacgctggtctgataagctccggaaactacgttcagagccaccgggttttcggtatcagtgtttgtttgtcctgtgaagtccacgatggtattggtaaacgcttgacgaccaatcatcaggtactgaggacggaatgtaccagcaaacgcttttgttgcaaaggtgtaagctggggaacctggagcgaatccatcatctacaagctgatcgagttcggtataagcgcgaaaacgttcagggaagacgttgtggatagccaggaacagcggggtttcaaaccctttggtgtcgattggttgagtaccaagcgtgactgtaacgtcaaccaccttgtcattataagccatcggtttcctcttctttatttctgtacatacagttattgaccagcacctctttgtgctgtattctgggggcttgcgccccctatacgatcactaataagccagtgcttatcaataaccgagtggttttctttagccttctgctgggtagtgataaacgagttgagcgttgatcttctccagttcttcgaaagctccggtatctgtttcgatgaagcacacgttaaatgtgatcaagacaacagcacgggtttcaaacttctgcatattcaatggaactcttaaacgagaaattgtcgaagaggacgagtatgcaaaaggagagttggttgggaaatatttgtcataaatgaacggtaggttcattgcttgcaataccctgcttaaggcgttgggagctttaccacggtaggctgtgagggtgtaaacaacctcataattatgcaccgtcatggcattgccttgagtatcaacaccttcgtcagactgccagtcaatctggtcaactgccgtcaggtcaacaagaatgaattcaccatccaccttgggaatctcatcttcacctgccaatacaacttttcttcctgtggtttctttacagaatgctcccactgtattggtaagggcgtcaaagatttcatccgaattggtgaatccagccattaaattcctccgttcgtcccttcggggacggatactacgtaagctctgaaacgggcgacacctgtagtctgataagcatcagatttaatcacagtgaaccacaccatttccccacgggaattcatcagcttgatttggtcagcaagctcgtttgagccttcaacaggacctttgagcatcacagaggaataaacggtgaaggagtcatactgtctaccaccttcctgcatcaattgtgatgtataatctcttgcagccttacctgttaatggttggacaacacactcaagaacatcaaactcttcatactcaatttcaacaccttggttttcgtatggattgcttgcgtcaacttttgaatattgtctgtgtcgccctgtaaaggttgggcgaggtattaatctattttttccaataagtctgtaaccagccattatgccctcgaccctctgctgttggatactctgaatgttgtggactctttaaggtcaccatagtggtacatcgcctcactgaatcccttgacatcggcccacgcatcggatactctgttatgaggaaacagaccggagtcgataacgaactttatctttcttgcacctgctttgccgatcttgtttagcatcggtgtcggattacgaccgcctgaagcaaggtatccgaaaagttccttctggagtttttccagttccttattgaatgcaactgctgcgcttgtcataaaggtacgggcaggaagaccattccaaccttcttgatggattgcagcgagcgttgcagtattaagacctgagtagtgagggtcgtcataataaccatatgaaacctgacgcgaatcaagttgttgggttgctctgaaaaagttctcaaactggctcagatcttgcttacttgtgaattttggtctcatagccacatccgtttaggtattttaccacattatcttagcaaaatcaacgaccaagcgaaggataattaacgaggccagcggtgagggtatctgcgaggaattcctggtacacctgtctggggtacaatgcctgcaacatcgaacggacctcttgagttcgggttccctttcacacgccagtgttcatcttgacggacaccaccaatgatgactaaactggaaaccgcgctgagacaaccgtccacataatcaggattggcctgtaaccaggtcaggaaatctgtccagttctggtatgtagaaccacctttcacctggattgtttcgtcaccgatcttttccaagcgttctgtgatagatgcctctccagagtttacttcttgaaggatcaaccaacgtaccacatcaacgagcgtgttataaacaactcgccacatgtcgcaggttgttgattgagggttgggccagtttgccttaaccttctcaatagcaagaaatgccagaattgtttcgtctggtaaaacctctgggggaatggacccaaggagcagtcgaatatatgcaataatatcttggtctgtcattttcgctcctgttggattgctcttctattaatcaatatcttatcacaaaatattctatttgtcattaaaaacacttgacaagacgttaagttctgttatctttaagtcatcaaacaaaactggagaacattttatgaaacatactaaggccgttatcattggaattatcgctggagcacttatcggggcgggagcttttacgtatgtaatgaagcatcctgatgttaataacatcaaagcaattgaatcaagttggttgtctcctgaagagaaaactgccagcgtccatcgacttgttcgtctcggttgcgaccaacgcttcaggaaagcattcaaacctggcgtctcagttgttcagacaggtaagatggatgagataacagaacaggctgaagcataccagtatttgaatgatgttgcgatcctttatggaactgaaggattcaaaggggcgtacatctgcacctattataaagacggaaaagaccccgtggtcaatgtgaatatggaagcaggtgtacgtaagcttctaaaataaaaggccccgaagggccttttgttacgccataatcccagcggatttaagcttcgcaagcagtccgttaaagtctgctaccagagtttcaacatcggttgctacagaatctgcctgtccagaagctttcttaacaccaccgagcgtggtagttgttgctgctggaagtgtgtaacctgcaccaccttctacgaggtcagcaacagagattgatttaccagtaccaacatcgataagtttggttgcataaacaagaccagctacaccagaagttgccatattttatttctccttataggaatgaggaaggtaattgcggaatattttcaacagaggttgcctgatccacactatcaatgtaagtccagtaagacttcatcaactcgtaatgagatctggatacgctgttgattaaagctgtcatttcactatgggtgaaatcagccttgtaaccatcgaggaactggaatggatagacatttgtggtttcagaaccatctgcatccaaaacattcttgatggttaacaaagttgcaagatcaaaactcttgacgcgaacttggtactccctctcatcgtaaggataagggataccgatgttaatgtccccgctaagaacagtttgtgcatcagcctttctctgatcttttgcagagacaaggttggccgcaatttcttcttcagtgaaatcacgtacatcccaagtttgttcccattcttgggtttggtcattgaaatgtggagcgccttcagtgaccacatccccttcaggcatttctttcggaattaccgggaagtaacctaactcgacaaggttttcagaatagatccaagaaccggtgctcacgttcggattatccgctctgaagtcagaaagatataccggatatttcccatcagacgttctgataagaggtgtatatgcgtaaactaccatttactctccttgagaagggggccgaagcccctttattaatcgacagtcaaagaggttgtacctgtcaggtttgtaccgtcccagaggatagtaacaaccgtgcgggtagttcccagagtaaccgctgtgccgtttgaccatgctaggttgccaggccacgtcagtgacgcaccggaaccagagaacacgataacgatggtcattgctctgtttgcaggtaggttagtgaagctcatggttttgtttgctgtaccgtcaaccttgaagacttgagacacgccaacatccatagccccagttgtagaagtaaccagaagatcgtaacgatcaagtttcttccacgcattgtctacacggacataatagcctgtatctgctggtgcttcaagtaccggaacatcaacccacccagcatttgttcgagcttgcggaatggtagaggctgtatcataaacgtttcctccacccatgtaccccagagaagcccatgcggtagcagatgttttctggaagtattccaatgtggatttattgatgaagtaatcaccaattcgcccatcagcaggacctgggttacgggagaagtttaaccaaagtgttccttggtctcctttaataccctggataccctgaataccttgtggaccctgtggaccttgtggtccaacatcaccttgaggcccttggataggtcccaagttctcataagtggttccagtccatccccagaaatctccctcaatcaagtatccctgaccaagctctccagtagaaggaagttcagtggtattgtcgagtttgccaaggatttctaccccagcacccatctgaccctctggtccttgtggtccttgagggccttctggacctgtcaagtcacccatcggttcccatgcggtcccgctgtaaacataagaataacctttgttcccaccggaagttactgaatacatccagccttgttctgggttttgaacatcaagcaggtcctcataagtcgcaataacacctttagcaacgatacttgcacccatcggtccttggtcaccttggataccaggatcaccctgtgggccacgcatgactccaagatttacccagttagtaccatcgaaagcaaaagcttctccagtgtcctctgtggtgtaaagatctccagttgctgcgccggacggcaaagctgcttgattggctactgtacctctggcagtcagtgaaacgcccattggaccctgtggtcctgtagcacctgcgggaccttgaggtccttcatcaccctgatcgcctttaggcccctgtgggccatcagccccagtatcacctttaggaccgacatcccctgtagccccggtgtcacccttgtcgccttttggaccaacgtatggacctacgtttatccattgagcatcagcctgactccagacgtaaaggtttggaactataatccaagcatcgcctggtgttcctgttgcaggaagatctgaaacagcgccttttgtcccaagaacacgagcaccataaccagtttcaccacgatcacccttcggaccttgaggtccttgtggaccgacagggccagttaaaccagtatcgcccttatctccctttggaccgataggtccttgaataccctgtggaccttctgctccagcaggaccctctgcccccgcaggaccttctgggccttggtcgcccttttgtccttgaggcccttgtgggccgacatcaccttggtcacctttaggtccttgaactggaccaatatcttcccaagtgtcgtcagatgtccaaacccaaacgtgattgtccgtttgaacaacccatgcatcagccacagcattaccaaattcaggcaattcgtcaactgttgcttttgttcccttcagttttacaattgcggcatcgttacctttatcgcccttgtcacctttaggtccttgaggccctgttaagccctgaatcccttgaataccttggtcacctttctctccacggtcacctttatcgcctttaggcccctgcggtcctgtggcaccagtagccccttgtggaccagcaggccctacttgccctacaggttgccatccgtctgcatcgccagtccaaacccacatctggtcttggatgatgtaggtatcgccttccgtatttccttgagtcggaaggagagatgtgtcagaaaatgcacccctgatcaccaatcctataccatcttgcccttgaggtccagcgaaatcgccaagatcagcccaagtgcctttcacaactgtccagtagtgagttccaattacgtaagtatctccctcttgcatggttgcagcaggaggaagttgggatgggtctccaataattccttggatgtaaataccaacacccggatcaccttgatcacccttgtcgcccttatcgcctttttctccgggagggacaaaaagaccttcttcaccagggtcggtcacttcaacaagaacgtttccggtcttggttgaaataggcacaacgatctgaggaggagcaacatacagctttccacctgccaatacaagcaggttatcactgagagggctaaccccgacagaaagtccgtcagggccagctacaagggcgttaccggaagcaggatctacaacaacagcggccttcagcggagtagtggagttaccattaccgagaagtgttactgtggtcgtatcttctgtgtggaattgtccatcgtccacaaaggttccaccgccagtaccttccggaaggataggttcagcgttgacgaccttatcattgtaatctgccatttttaccccttattttacaggctctaattcttcaagcgcagccttgaagtcagccatcatgttttcgaaagacttgtttttggcaagggtaatgcctttggttgcagcgaggtcagcaagtttatctttgctcgctttcttgtcagcttcgtcgttcagtgcttctgcttcagccagaattgcttcgtaaccagcagacttcactttcacctcttcagtcttgacttcttcacctttagggcctacaattgcctccactgccttaccgcgacgattcgggtttggaagaggactgttgaagaatacgatgtatgtacccatgcggagggtagagtgttctgcatccacatcaagtccagagatctcggcaagcgccttgaagaactcaacagagttgcggaaagccctttgttcagtaccgacacaaaagccgttcagaggaagacgggcagaaataccaacattcagatccggtgcgtaagtaccgaagaatttgaacaattccaccttgttagggaaaatacgatagttttgattagccataaaatctccatttggttaccttagtaaaaaccacttgacaccgttgatgaagtggctattattaaggcagaaaaagaaaaagggagaggtgaataatcacctccccctcttagaggtagcagttacgctatcttatgcgaaagtaccagtagagcgaacaaccagttccggacgggtgttaacagtcaggaaggaagtttcggactcaactttttcttcacgcaggtatgcagaagatttgtaccacaggtacagttcctgtgcaggagtgttcgcttcacgaacgtcatctgctggtgcatagtgaatctggaacatgtcgtcgattccttgcggcagaatgtaagcttcaccatcagggatgtagttggagatatcctcgatgtaagttacgttcttgtgaacgaacatacggttgttggcgttctctgctccctgacccagacgacgacgaagcggctcttgagtagaagagtagtattgataagcgttcattaccagcggatgagcgatcagcgctgagaaccacttacgagaagccagaactacgataccgtagttgttgccattgtcacccgcattgtcgatgatgtaagcacgagcttcagcttcgagaacgtcagtcgggtcgattgcaacattggtgaagtcaatgtttgcagtgtgctgagtaacaccccactcggtgaagtagttgtactgagcagtcgggtcttgtggtgcccaagatttacccatgatcgcctgaagcattgctttttctttcagttgttcatgagagatgcggatacgacgaaccacacgagcaacaacatcttctacagtcttcggagcgtcagtagtgaaatacttacggaagttctgtacgtctgccggagtgatctgacgatcaagtgggaagaacgggatgttgaagtttttcagttgggccttttcagtaccaacgtagttacgttcaccctgacgacgacgagccgggaagtcggttacaacttcgtcaacacgttcaatctgagcgacagtcgaaacaccgtggtacgctgtgaacaggtccatgttggtgataagacggtactgacgtggtacgatttccagagttgcgccaagatcgacgatctggaagtcattagagcgtactactgccattgttattctccttggtgtagattagatagacgttactgggatctcaacagagccgtcgtaatatttatcggtgatcttcagacctttggcctcaagagcagcgatagcggcagcgttgattgcagtagtaccgtcagcgaaaaacagtttgaatttgttcagggtcagaccacgaaccgccacaacgaagttgtaagtagtaccaaccacgaagtcacgaggagcatcgtaagcaggaaccagatcacggtcagtgattacaccgaatgcgtcagcagcagcggaagcggcaattggttcgccagcggcgttcacaatcatacctgctttcagaccagctacgaactcaatcggcatttccaggaagctgtagccctggtcagaagagtccactttacccagaacgatgtcagagtagtacccttggattggattagccatttatttaaatctcctcgattaggcgtttagtgcagcagcttcacgagcgcgagctttcgctttctcgatgttagcctgaaggatgtcttcggcagacttgttgatgtcatcaacagttgcttcaccgtcttttccgtgttcagcagtgccgaactctttcttcacggtttcaacttctgtttccagttcgctaatacgagcttgggctttttccagaagagctactaccggagcgttagctttttcgatgatgaaatctgccagagaagcgtggtcagcttcagcagcaaaggtgaaaccttgtgctttagtcagagcggctttcttttctacttcaacagcggctttgatgatttcatcagcagcagcagctttagctttggcatcttccagttgcttaaccaggtcaaggtattcctgagacttggttacatcagtaacattatcggacactgaggtctccttattttctttggatgtatcaattacagggtcagtacctgcttctttgacgaccccagtcacctggagatcttcggactcaccttcggagaaggtcagacctaattcgcttactcccttttcaaacagttgctgaagcttcagaagttcatactgtttaacaaggtcgatttcttcaccgctgtgcgctgccttggcgatagagattgactccatacgcccttccagccattcctggtgctgtgcgttccaagcttggacccactcatcatcagggttttcagcggcctcattttcaagttcagtttcaaagcccagcagtttggcaagcagttctgcatcgtcgctccacatatagaagaacttacgcaggaactcttcgaaactcatggaaacggtaacctgttgcagcgccttgataacgtcttcggtaatctgttccggtttcaggtcagacttcatcagaagtgatactggacggaggtttgcagaaaacccttgactctcatggcagagtgcgatacctttttccttaatggacttggcttttgcaattgtcattcgccatcttcctcaacatactcgacaccgaaatcaacgttggtgatttctcctgttgctttgtcgattgatccggaacactgaatgctcaggccaccaacaacgttggactttttaaggtcccacagtacagggtcgttatatttaactttagctacccaggtgccagccttgattacttgctcggtcccgataaccaccacatcaaattcttcctgaatccaagtcttctcgattgtgaaagagtcagtctcaatcatgtggaagaggttctctttaacaatgccagcttcgtttgccttatcaaaagactccttggccttagcgattgtctcagcagacatccattcgccgtgagcgtccttggcatctggttcgtagataacttcgtaagaaatcatctgctcatcagcgtctttctggatgctcacaacagaggttgacttgttgatttcagtcttaacattcattttgagaatgtctttggaagccttctcgatagcggcttcaggagattggcctgaagcaatcaggccatttgcaatactcagtaccttgctcttctgaacgagagacagatcagataccgatgcaggaaggtcagcaatacttgtgtatttcatcattttccccgttgatagttattttaacaccgttcattttcttttgcaagctatttcagtaagttgaaattaattatccatattggatacggaattgtctcttgtggaggagatttttcctgttccattaccgttagagcctgctgtcataccatcaccggagcgactggtatcctgaccaaggagtttcagaagttcatcagttgacatgtcttccgggatctcttcgtcaaagccaccaacttcaagaatcttgttgataactgtaggagttttaggaagatacccaacagcaccgatacgctgaacgaacttggagaagccttccatatcgacttcttggataaggcctggtttcagttttggcatgtcttcgtctgaaagacggatgtcattcagtgccagaagctgagggatcaggttcttgttgaaagcctcaacaatgatgtcgatgtcacgctgaacgaaatgtccgtggatggactgcttcgattcagataagttgtaagacccctgaccatcgttaccaaggttgatgaatccagcgccaaatctgtcgaggattgccttcttacgagagttcaccagttcctgtgtactgtactgcttacctgcaccgtcaatccctttaagagacatcttgtactgttcaccaccctgagcgttcatatctgaaggcaggatgaagtaggcttgctcacctgcgtgggcgtttgcagcatccgccatcaatccttgaaccatttctgattctggtgatttcgggtcaatcgctgccttgttcaagatctgagaagggatcttgagttcgatgataccaccaagatctttggaagcaccaattgtttcgaggttctcaatcagaatcttttcacggaaagcacggtaacacccaacaagaggagaaacaccagcagggtttgactctgtaccaccaagactcatcaccatcagtttattgataggaatgaacacttcatccgcagaggaggtcagattagtaaccaggctcatagcactggagatttgcgtcagaccgttctggaagttggcaaaggccatcttactctggtaaatccctttcagggtgcgcccatcctcatcaaaaacccaaggttttgagcgagaaagacttgattgtggcctaaaggcaatcttatcaatggtgatgtacccagcatatttagatggggcagattcagtacggtacaccttctcaaagatggagaatccatactcattaaaggttgcggcactacgagcaatatcgcgaagagtttgctggttggcaaggttcttcaacgcgtattctacaaactcggctgcatctttggatgccttactgtcacgattatacaggactttgaaatcattgaaagctttcgttacgaaaacatacttcgtatcaagcgccgtggagacagtatggtcctgcttcatagcctcgacggttgccagaaaacaaggccagcgtaactcttccaccttcataacttcggattctgcacgaagctgtgaaagagcaccagaacctagttccccggtacggagacgactaacagccagattttcgtttccggctttaaccacctccgatggttgtgcaaatcttgttgacacgagttatcccctctgttatattctcttgtacaaggtcggagcaacaattttcgggataacaacaggtctgacgatctcgttcttctccaagtaattaataccggaggcaacggcatccgcccagtcatccttacgggttgttgtgcttcgctcaccattaaacttttcaagttcagtcattaaggcttcatatgtcttagcatcgaaactgcttctgacaatcctcaccattcctgactgagcaagttttgcaaaaggagtgaagcgtgtaagttttgatttattccctggcgtcgggtctctctcaaccacaaacccttcagccagaagctcacgagcgctggttgtgaactcactaatgcctgcttgaccggggtcaacgctgaagatgataacaacatcatccccatcgtaatgggcttgctttttaatgatcacatcacgttcaccagctttcttacagaaacggccttgcgtttgagtggagtattgaccatcatcaacaaactcagggcaataatctcctgaaagataataaaacccatcagagtctttacttaccttcacagatgcagtaaagtcagggtatctgttaccagatgttcgttctgtacctgccttgtcgtatggtctaacggacgtaacgcccagtggtaggcaaggaacttccttgagataggatcgctggaaatagttcgcaccttctggacgaactttccagtttccgtggagtagctgtgccttttcaatttccggaagaccctcaaggaaagcaagataatctgggttgttgtcaagcatcggtgggttatcgaagatagtcgcactgatgaatgagaaggaaagtggttttggcttcttacgaatgtccacaccgtcccaatactgctcaataagttcctctgctgtatctccccagatgaactcaccgtcacgacgaatgaaccaacggataatcccgtctcgctccgcaatagggaaaccatcatcgtcgagataccactcaatcaactctttaatcttgtggtctgggtccgggttacatgagatgaccatacggcttgggtatttggattcagaacgaagacgagacatgaggtattcgatctgagaccattcaaactgtgttccttcgtcaaaaccaacaaaggtgtactgtagaccctggtgagaatacttatctttctcgtattccatgtgggaccattttactttagcaccagaagggaaaattgcttccaggtctttctccctgaagcgtggtttccattccggatcaagctgtgtataaatgcctcgtgctgtatcatacagaccaccaccacccttcaactgaggggtgtttctacggaacatgatgcagttcgttcgtggatcgtcgatgatatttaacggcattaattgaagcaggtaggatttacctgaccccgccgcacccccaatgatcaggatttgtgcgttgttttccaggatcattttctgcttagggctggcaggtccgaatgttttactcaaaagacctccatattaaaggcgtaatttggcctataggaggtagtttaccacgaaacttgataaaaataaagcccttatcacgaaataagggccttgtcaatcacttttgcggattaaaaatgttacggacgtattgttgcagagtccttaacttgctgcggtcgttggcagcattcaggttgttggtcttcatgatcgcgctgttctctgagtttgaagcaccatacttcaggggagttggctccacaggatcaaccattgcagcagcaggtggttgtgcaagaacctttgcaggatcaaacttctcaactaccggaacaacctccggcttcgcctgacaaccgaccagtagggtgactgccatcagcactgccattaatgctttattcatttcacccccaagctttcgttgtagatgtcaacaaactggttgtcaagcccttgcttcttgcctgcatcagacctgctgtaagcgtcttgctttgcgttaagctgtgcctgcaattctgcattttttgcctgctcttctgccagtttcctttcaaggatatcgcttgcgatctgttgttcatccttgtaagactgattctcatccttgttttgctgttgcacatccttccattttcgatctgtatcactcacccctgaattgtaggactgcgtgatctgctcgttataccagtgctttgcatacaatcccccgccaacgaggacagcaagcaggatgaccactgcgattacctttagattgcttttcagaaacttcaaagccatttcaatttgtatcatgagatttccccattggtatcaattacccgctcgattttgagcagagttgtatcttcatcttcgatctctattgcagcatcattgtaggcaatcttggtagggtcgctcacagacacctcaagaaggacagcgccaggtaaagaggttttttctccccatctaccagttctgcctttctcaccccaactcttgtatacgttcaaggcttcctgctcgtctacataaaggttcatcacatcaaggaaatcttgtgctggtttctcctccagaagaccaactttgtgcctttgctctacagcttgcatcaggtagaagttgtcagaaggacaaactccccacagagttttaaaatatggccttccagtattctttcggaggcgttggtacatggtaaagatatttacctctttaagacctgtccaaccacctttaccacccttctcagagtcagttgcaatagcgctgatgattttatcaccagcactatccagtttatcaaataatagctcaaatgaaaatggcctttcttcatcgaaaagctcttcaacgttcgtaccatacataccactcaggtgggccttggcatcttcccaagtttcaatgctcaaactagaagctgcaatgccaagcttcatggtctcccggcgagagattgtataaccgcgagcgcggtacttatcagcacgaagcatactaataatcgggtaatctgtcttgggattcaataccaaaaccttctgagcgatgtgcttcatgaaatttttgtcaaactcccactgctcttttgcaaagctgaatgaccccatattaatcgtaaagtcaaacttatcaaatatcttctgtgcatcagggaaaacatcaaaagcgatacattgcagaaccgggagcttttttattggtaaacatgacacttttatcggtcataccgatattgtcaatgttgtcaatcttactctctttaaccgcttgggtgaatgccttaaaatcctcatcagacatatctttccagatttttgccaaggcaacaactgacaggcgtgtcatcggtttatcttcagatttgatcaccagggtattgacataatctttaaagcttcccggatcgtcaagttccctgaaatatttgaatgaccgtttggaattgccccaattattagtcgcctctgtcaggtctgattgacctttcaagaggctacgatcagtcatgtacgcaaggaaaacttccaggttctcccatgaagggaagtaaaggtctatgtcgtttacttctcggttggagaataaggatgtgagtgtaccacccgcaacacggacatcgaggcgtttaaggatctccatcaacccgtttggaataaggctacggaggatcaggtattcacgttggtattcttcttttggaaagatatgaagcatggttttctcctttagtaattaaaccattggagtgtaccagaaaaagaaaagccccgcaatagcggggcgaggcaaaggagaggagattgaatatttattattattagaataagaaaagtggcgaaggaacctttactcgtcgagggtgtcttaccgtttccacagccgagaccttccttagtgtccacttagttatttggatgcgtgagcgggagtcgaacccgcaatcttcggcttatgaggccaacatgatctatatatccgtttcactaccacgcaattgtttggtggggccgggtggactcgaaccaccgacctgatccttccaagggacccacgctgaccagactgcgctacgaacagattgtgtaagttttaattgtcccagagtcttacaactggtatcgctggctaggtaataagttctccaagcaaagttttaatttgcaaggaggatgtttggcgaggccgaaggggatcgaaccctcattttccgcatagacagtgcggcaccattaccttgtcagccacggccccataaatttggcgacgagtgaaggatttgaaccttccttgagttttcactcacggcttaacaggccgtcgcccaaccactaggccaactcgtcatttaactactttatcagctaaaacaatcttttgcaagagttattttaactaaattaatatggtgggtcgggtgggattcgaacccaacgatctctcgattaaaagtcgagtgccttcgacatacgtcaccgcttggctaccaacccatatttggaggagagcaacagaatcgaactgtcaccgtatcgctacgatgggtccgggttcaaaccggattacgcaccatgcgtcctgctctccggaggaagatgtcagacttgaactgacacacccctttcggggctactgtctctttagcaaagagatcccttacctgattagggttaatcttccactcttactaactttgcactaccatgcccatcgacttcaatattggcgtagtgatactttactattttatcatccacaatgtcaataccaatcactaccatattttcatcatttttcatgatctctccaaatcgagttgttctttaatctctttacggagatccgctttttcttttgcacgagtaataggtatgctttgaatctcatctgcaacaccacagttacttccgtggatcttgcaacgaccaaacaccttcttacaacgtaaaagcttctgcataatatctcctaaagtggcggtggaagtaggatttgaacctacggacccctgttaaggggccgacacctttccaagatgctgtcttaaaccgctcgaccattccaccaaattggggtgacctgtgggtatcgcgcccacttcctcaacgtcacaggttgaacatcatctcataaatgcttaggccacacatgagcactctcaaaagaaaatgttcaaatttggcagggggtggaggattcgaacctccgatgtcgagttcaaagcccgatgcattaggccagctatgctaaccccctattggcgtgaaggtgaggaatcgaaccccttacgactggttttggaggccagcttgcagccactgcaattatgttacccgcacaatgtttggcgtcctgtgcggggatcgaacccgcaaaccccaccttgaaagggtggtgactttaccagtttgtctaacaggacatatttaagcgtcatatcggattcgaaccgatgccaccgacttggaaggacgggatgctggaccgctaacactaatgacgcataattttggtgggagtagcaggctttgctcctgcgacctctcgattatcggtcgagcgctctactaactgagctatactccctttgttttggtggcccaccctggattcgaaccaggaaccccgaagggcacggatttacaatccgctgcaatcaccgttctgccaatgagccaaaatctttatagcggtggacgacgatcagcaaagaagctgatgatccaaaccacaatcgctacgataaatacaacttttgcagcccaagctgctgttcctgccaatgcaccaaatcccagaactgccgcgattaatgcgataacaagaaacatcaaaccccaattcaacatattagtatcctcatattaagatattttggttaaccattttgtttgaaaggaacgatgtcggtagtgaaaggttttgatggagccttctccggaaccttattaccgtcatcaacgtttttagtttcttcttcactttcattttcttcatcgaagtaatcagacatcatttcttcgcctttttcgatgacgaaacgtgcaatgttctctctgatgttgtccttggtgctggaattcatcatcaggtcacgtaaaacctggtgtgcgtcaggaatcatggcgatcatctttgtcttcaggtcaagaagattcttctcaagctggattgcgtttgactcctcttttaaaggacgcccttttccacgacgacgctttgtaagctgttgttttgctgccataattaaccccactcattcatattatcagagatgtatttctctgtcaagggttattttaacataattcactttaaatttaaagtgttggagcacggtagaagaatcgaactcctgacattcggtttgcagccgaagctgttgccactccagcaaccgtgcttgcgtggacccgattatttcaattcctcactcacattcgggtcaagatgtgacacatagccgatcaaggcgcttcctctgtctcggcgtgatcgcttcccggacagtcatatgaatttggtcgaggtggctggattcgaaccagcattgagcggtttagaagaccgctgcctatcccttagactacaccccgttaattctggtgcaggtgacgagactcgaactcgtaatcatttaagcgggagattttaagtctcctgtgtatctccatttccaccacacctgcaatcatcgttcctgaaataagatacatcaaaatcttttccaagagcaggtccaccgctttgtatatgcttaccatatttccctgagcaagacctcgaacaaaaaggaccagattttttatcagatctgttcttcctttgtgattttgacaatttaaaggtattaccacaccaaagacagttgcaatatatttcctttgctcttagagcgctcttttctgcgttagcctttcttgttaagacttgcagattagagatgttgttgttattcacatccctgtctatgtggtcaactgtttctaaatctggatcaagctctcttccaagatgcatctccataagatactttgggtagcttcttgtcatttgcataccgtcataaagatagatgatcacatgttgcctgccatcatccctaacatacagacctaaaacttttctaatcttatcgagatacatatgcctctaccaagttggaccaaggacgcaaacatattttgagttgcatggtgactccaccgacctcctttctccgcgaaaggcgctctacgaccctgaaacttctgttacagcaacgtggcctttgtcactgaaactccattccgttaggctcattctccgcacagatgatcagtccgtggttcaaataacctgagctaatgcacttcaaaatatgctttggagccgggtgacggaatcgaacctgtgcttatcccgaatcttgggactgctctaccaacttgagctaacgaggaattgtttggtgctcccagtaggaatcgaacccacttcttcggcttaagaggccgctacactaaccgctgtgttaataccccgaatctggcccgtgtttttcaagacgttgcacgggatcgtcacggttgccacggccctttattttaagacgcatcgccgcagccagcttcgtctatccccatgccggaggaattacttcttcttacctttcggcgctacggcttcaacaaccttagcgtctttagctttaccagcgcgttcacgcttggtcttgccagtgcgaacacgatgtgaggcagaaatgacctgaccaccttcaacgcgggaaactgattcccagatagatacaacgttgccatcttcatcacgacgcttcttacgaatagaaaccgtctttgttacaccgcccagacgaacatcatgaggggcagagtgggtctgcgtagacttggactcaaactggaacggctgtttgattgcgtcgattgcagaaactttcttgtttgcgtttttcttagccatgttttatttctcctctatttgctaatgtctcgttgacgttggtaatactaaactctctcacttcctttgtcaatcgttttttaaatcttttttcacttctttatgaagaccgagtgaaaggtcataacgatcatatgtatgaaccgaggttgccttgatagaatcaaatcggcttttccatgattctgacatacttggtttttcaatgataccaaaaaactcatatacacgtttcattgcatctcctgtttggtagttctggcaggaattgaacctgcgacctcttccttatgagggaagcgctctaaccaactaagctacagaaccattccgtcttggtgagatgaatactaatggttaaagaaaccattgtcaacacctaaaatgaaaaaaagcaccggatttttatttccggtgcttctggtattacttgcgatatgaagtcgcctggttgtcaagacgctggttagctcgtgcagcgtcaccgcgaacaatcagaacatcctgcttcatcacatcaacgtcagattgcagttgatcaactttctggttgagagttgcaacatcgcctgacagtttttcaagacgctcagttttgtggctggtgcaaccagttactgccagtgtccctaccagaaccgcgccaagaatagcctttttaaacattttatttctcctgggttatgtgcagcagtagtatctgcatgatctattttactgcaaaaggtcccaatttacttcaggaaatgtccgaaacagaaacattctgtttacaaacattgcaggtggttaccttctttggacccatgaacggaaggccgcacacatcacattcagtgtggtaataaaaattacggaatgtatcagtgggccagtctctgtcgctcaattcaaagattgagtcaaaggtctggtctttcatcagaagaaataccctctccgaaacctacgaaaatatctacgtcttcagcctggcgaatgccttcaccgtaaccaataaatccgtcaaattcgtctttcatctttttactccttttcgctttgaacgtgtaatcgccgcttcagcacggcgctgcttgcggtttttatactgtccggaagattcggagagcgtacttgattgtggaatcaccgtcaacggggtagaaatagtataagccgccttcttctccgaaggatgcaacgtattgccatgcctcaatgccaaagccagtcgtagaaaaagcgatgtcattagcttcttcagtcgcttcgtcaagggttgggtggtgtgattcgtgctcaatgtactctccattatctgatttatgtacaagctttaatttaaacataatgacctaccgttaagttgttaagaatttcgagttgattcgatagcttagatcttatcagtggtcactatttttgtcaatcaaacaatccctgatgccttgacaccacgacgatattctgctagtgctaacgtcttggggtcaagctcttcctcatcttccttcggattatcaatctcaaggaaatgttcctccagaccatcaaggatgtccggctcccacgccttcttctggtctgtgtgtacagatgcacgattgaaatcatgacgactaactggatttcgcactcaatatctccttttctctatctcgccaaaatattgcatcatcaaggttcctgaatgttttatttcgtttttcagttccccattttattgtcacaacataatgctttcgtttttcaacccacgttatgttaacatgtccagtgtttgaagatgcagtgacattcctattattcatttcgcgtgttgctttcttcaggtttacccacgcattgttggtccttatcctgtcatcatggtcaacaaattcaggcatttctccagtcatatagagatatgcaagtctatgagccaagtatagttttccatcaatacgtattacaacataaccgtgctttccaacgcaagaacactctgttccaccaaggcgggtagcgtcttcctttcttgaaaaaccctcttttaaccatgtgaaaatgcctgtctgcggatcgtaatgcaaacgggttttgagatactcttgcgttaaactacgcacaggattcctcttccaaatcaatttttcctgttttagtgtttacccacactgttttatccttgctggcgttcatctgatgaccgcagccaaaggaaatgatgcaaacgcctgggccgtgggcctcaagatcagcttcaaattcctgtttacagactttgcactccatcattactggtccaaacatcttaggctccttaatataatacgggtttgttggtgtgttattacacgtaaggcaatctcgtactgggacttcatgccacttgcatggattttccatagcctacctatcagaaaagcccccgaaggggctgataatttaaagctgagaagctgcccgatcacgaatctgtgtcaggtcttcgtcaatcatcaactgaccgtctcggaagacacaacggagttcgttatcacgagactgtacctcatgcacctccagattgtcaaccagttttaactgattgtcttcatcacgaataaccttcaggaaaccttttgcagatttcttaccgaggtcagtcttcggctctttgacaaccatgatctgcttgccgtcgataactgcacccgttgctttcacagccatacccagtgaatcacgagttgtgtactgggttgtgtaagaaccaacaccgtacacgatgttactcgatgcaaagccacgatctttcagtcgttcaaagatatcttttgcacgagcaacagtgatagagtcaccgtagatcaggccgacatgactatcaaggaccttgtaacctttagagttgacttcaccaccaaagatatcccacaggcactcgaccgcaccttttacctcgtgctcttcaagacctgaaggctggaaatcgaagaaggcgttatcttcatcgtcaacaagaatgcggtagtatttaccttcaatcttggcaacttctgaatttgaatcttcctgcaatgcagtatgtgcatcagaccagtcatcaaagtcacccaggttacgataacccgcgatgatgtgctcaggaatgcctgagtcagggcggaacactacacgaccgtcacgagcaaggatttcctgtttcaggatcgccgcagctttggtgataatggcccagaaatcataactgtctgccacataggaaacaaaacctttcgggaagatttctgtgatataacgcttcaggaactcgacttcagcaaggaaacgcgcctcgtccagagacagttcagggtgttcaccttgcagacggccaacaatgaaaccaatatttgtggtcgcaacggagtgctcagacgccgggatagaaccagctacaaaacgacccttcatgttataataacggttcgcatacacaatcgccgggatagtgtcagtacccatagagttgatcagttgaccaaattcactctgtgctgcgtcatgtgtcccaccttcaccacgatatgcaaaacagtggttctggaaaggaacatgcagattattatcacatgtttcagcagcccatttctcagacagtttacgatattgccagaatgttgttgcagttgtgattgttttccaggtttctgctgacatcacactttccaggaagttcggtaaccagtaaaaatccggatgggtattctggatagtgaacattggaacctgcaccggagccagagtgccttctggtaaagcacggatttccagaggtagataaccaagatcgtgtagcttctcaaaaccccacatttccaccatacccggtccaatactcagttcgcaaatttctttataatctgaaatcgcttcttcctttgagcgtttgaaaaagttttcattaaacatatcgatcaggaaccacttgatgaatccctgaataccagcaaacatcacacggtggtcattgtctgcgaagtggataaagtgctttgcgttacgggcggtcatattgtcctgaacaatttcagaacgtttgtcatacatcgagatgtgactcggtttgtaaaaatcagcgaaagtaatcgggctttctttatgcagcatgtttgtttctcctctgtgaaatttgtgggtgcattcttgcacccgttttatactatgtcaagaaattttagaagttttctgtccagtcgtgatatgcataaatttcatctacaccaccatcaagaatgacctgcttgccgaatgagaaaataccgtgtgttacataaaggataacacgttttgcaccattctccttcaacgcttgtgcaagggcgatgaatgtgcgaccaccatcacaaatgtcatcaacgatgacacattcacgaccagtaacatccccgaagacagcagtacctgtgatctcgttagtttttacatcacggaccttacctgcttcaacaagcggaagacggagatgttcagaaaccttctgcgcttttttacgtgctccggcatctggtgcgataatcgtaacatccctaccagcaagtacatcactataggatgctgcaagttcatgttggtgccgaatacgaacattgttcagaagtgcagcagaaacatcactgtgcgggtcatctacgataaccttatcaaacccaagtgagttaacgatgtttgcaaaaaccttgatggacaatgcctcgccaggttgcataacacgatcttgacgcgcataggggatgtacggcaggggaaggacatactgtgcatgaatatcaatgttatcaagtcgagagcaagcatctgccagcagagcaagagccataacatccgcagatgtcttgatttttgctgtgatgtcaacaaaaccaatgtgaccttttggtgcataacttaaatcgatcttaacctgttcttcaccacccttgaatgtaaggcgatcaacagggactatcaggttgttcagacgaagttctaaactcattttatttctcctcaattatttgaatagcctttaaaatatcttgcttgtggattgtctctgtgaagccgtcaggtaaccaatctttttcacaaacaaattgtgggatcgcactcaacacaatctgctcaactttggcagcttcagcataacttttgaacagcttggagtacatcagtttgtgctgaaacaaacttttctttgattgttggcgcattctttcgaaaacattaaatgctataccaacttttccgattgttaagcctgggcctgcaagctcttgaacataaacgtagcaggttctttcaaattttggatttgtagaatcaccaaacgaaatactgtactgaatactctccgctccactgtcagagatggcggttttcttctcgatccaacccttttcatacagagaagagagtgacctaccaacagtggctctactcaaccctgtggagtttatgaaatcttggtaagtataaaccccaacaccattcaaccccataaacatcaaaagaaccttttcagaagcacttatctctttcgattttataacttcaagcataacatcctctatctattaacaattatgtaatgccttggttttgcattccctttagaatcttgaaaaccagagcgtatgcggcgaatgtatccaagatactctatctttgtcaagaactctgatactttcggttgtgacttctcactcaacccaaaaagatgacacaaagatttttgagatggaaagaatacctcatcaccaccatcagggtttaaactcttgaagtaatcatacctccaccacaattttatcaacctttgcaaatcttgtggtgagagacggtcatcaaaaagccactgtgtcgggatagtgacgtaagagccatcccttatgttcacagtgttatcaccaatctttatctccaccaccatctcctatttattccagaacagatataattagaatgtacaccaacgtaacgcagatgtcaacctaattattcccaatcgggaatgtctaattattcccaaaaaggaatacaatactaacctatcaattaaactaacttatgatcttttaaaatcaaaacaataaaacataagatctatataaaagatctttaagtatgatctatatattctacagtcatagagccagtggctcagttgggtcagttgggtcagtatggatgaacaaaaatctgttgtcaagagttgacttctcgttttgttcatgtacaatgctcctatcgttttagaggagagtgttaatgttgtcaagtaaacaagctaaagctgttggagatatggtgtgtggtaagagtcgtcgtaaggcgatgcctacagatgaagaaaccacacgattgatgatggtacgtgaagtctttcatgaatgcaataaggatcagaaagtttgtgtggtgttaccagatggtaaatctgcacaggaggtgtttggaaattactacgactctgttcgtggtcgtctacgcagaccaaatgtggtggtgactcagatgaaagacttgacagtggagcacatcgaaggtaataattgtgtggtggatctgagtgagattctcataacgctctgagagcctctctgagacgttttgttggtgtggtggtacacttgggttcctcacaccattttaattcaatacagggccgctcagaggctctgagggctattgtggaggattattttgaagcttagtcacatatctggtgaaaaatctgtatgcagagaggcttttatggctctcaagaacatcatggctgtcgctgaaaagcggttcaatacaaaactgtatctcgacagccgtgtggatattggtaagtcgtggttggagtcatgtgtgtacattcatggtgatcgaaatgtcgtcaacttggtgtgcttgaagcttattacttggcagcacaacaatctgccccgtggaaaccaataccttctgtacgcataccctgcggaggacatggacaaatgaaaaaagacatcaagaaacctgtaagggaaaaattcgatacaacagcttttgttttcaatacaaaggttgagatcatcaaagaagccattcaacgcttgcacgatcaagaggcagatcctaacgcagaaccacttacaaaagatgaaatttactggctggggtggtgggaactaaacatgcctgaactggaaaggcgtggactcacagaggttatgacgtgcgcccaagagaacgccgctttagggctgtataagaaaacaacgaaaaggaagaaaaagaaatgactaatatcgatcatgtaacatcagatacacattggtggcataccaatattcttggtttcccatcctgtgataagttccgtaaaaacctgtacggaccgaaagaagattcagcgagtgttgtcaagatgaatgacgacatggttaaaacatggaacaaacatgtgaaacctgatgatgttgttgcacatttaggtgattttgtgatcgcgtatggtaagcatgtggagccgaaggttcgtgacattcttagccgaatcaacggaaagatcattttggttggtggcaaccacgacaaccacacgacaaagcgggtatttcgcgagtttggtcacgaagttgttgactataaagaaattgatttcagcacaggaaaagaaaaagttcgggtgtgtatgtcgcactacccgtttgcatcttggaataaagcacaccacggatcagtcatgctccacggacatagccacggctcatataaggcacctggtggacgaatccttgatgtgggttgggatgtccacggtcgtcctttgacgatgcttgaggccgtttctgagtgccttaaaaagcctatttacgatattcatcactgaggagatggtatgcacaaccaaaaacgcaatttcttgcctaagaaaacatcaaaatctttttacgccacaatacatattgctggcagttacaaccaggcggaaaatctttgccgacactgggtgatgaggggagcatgtgtgcagatttccccttgtacttatgtttatactggtggtgtggaagacggtatgactgtgcgtatcatgcagtatcctcgttttgagcgaccagaacatgaaattcttgacatggctgttgaacttgggacatacttggctcaggaattatgccaggtaagcttcagtgttgagacaccgtataatacaacgtattatcaggcagatggttatgaaaaaagatcttagctcccctcttggtatcaatgactctgatataattacacagagggttgttgatggaaaaaggattttccatcctgtatatcttaagtggcgaaatatgttgcgaagatgtcttgtaaagcacaataaacaccaatattatgaaagtgtatcagtatgcgatgaatggtattacctttccaatttcatttcgtgggttggtgatacggatgttgctggcctctacttggataaggatatcctcggtgacggaaaaatatactcaccagagtcttgtgcattcgtaacacaagaatgtaatcaattcttttcatctgttaagaaaaatggcaagtatatgataggggtttccaaagaaacccgccttgcggacacattttactgccactacaaaggaaggtatattggtagtttcagaacagaaaccgatgctcataaagcttggcaaattgaaaagagaaatcatgcaaaatctcttgcaatctcagaacaggatgttagaataagacaaaagctgcaagatattattgcaaaaattgaatatgacatcctaatgggagaagaaacatgctctttaacgtagacgatctggtcgctaaaaagctggtcaccaagaagacttacactgatggcccgttcgctggcctatcagttctgaagtacaaaaacaatgtcttctgggataatctgtggaacacagatccacgtctcctggaatgccgtggcatggtggttgattcggatgacaatgtggttatctggcctttcaccaagattttcaatcacttcgaaaatggcacagaccttccggcagacaaggtggttgatgcagttcgtaaagttaatggatttatggcatccgctggtgtgtataagggccagcttgtggtgtcaactacaggaactctggaatcagactttgcagttctggcgaagaatcacatcattgctgaatgcaatgacattgagcacttcattaagtggacagaaagtgcaaaggcgacgttcatcttcgaaatctgtgatccatctgatccgcatattgttgatgaagagcctggggcgtacctgattggtgctcgaatccagaaccgtgacggcacaagttttatgctgcctgaaggtgctcttgacggaatcgcgaatgttactaaattcaagcgtcctgaagttcaccagatggttaaattttcagatgttgttgaaatgtcaaagcattgcaaccacgaaggttatgttgtgcgtgagccaaactatccgttcagcttactgttgaaaatcaaatcccctcattatctggcgaagaagttcttgatgcgtggtggtgataacaagtgggatatgatctgggatcatccagacaacgcaaagcagcgtattgatgaagagtattacgaattgcttgaccatattcgtgaatactacaccaaagatgcttggtcagctatggattcacagcagcgtcgtaagatagttgaagattattttacgatagaagatctctttgaccgtgggagtcgtttttatgttggtgtggctcgatgacttaagggaccccgttaattacgggcatccagatgccttgtggataaaaaattcgcaggattttattcagtttctcgaaaatcggtcaaaaccatatcgtcgtgtcacggagtggcacttcgataacgatttaggcgaagagtctgaacacgatggttattggtgtttccttgcccttgaggaaaagattgtcttcggaaagatgttgtttgggcctgttaaagttttcgtacatacttcaaacccttcagcagggcataagtttatgcttgcaaaagatagtttggcacggtatggtgtaaccattctgagaaacaattactgaggagagggtatggaaaagacattaatcatccttcgtggggtttctggtgcgggtaaatcaaccgttgcagaactcctgaagaatgacagcaatgttccacattacgaagcggatatgttccactatgttgatggtgagtaccggtggaagcaggaaaaccagcacaaggcgcacgagtggtgccagaaaaacgttcgcctggcaatggatatcggttatgatcgcgtgatcgtttcaaatacctcaaccagcgagaaagaaattaaaccgtaccttgacttggctaatgattatggatatcaagtagttagcttggtggttgaaaaccgtcatggtaacgattctattcacagcgttccgcaggaaacacgagatgctcaagagcgtcgtctgcgtaactcgttgaaattacaataggagaaataagtgagacgtttgattgttatttctggtgctggtttctctgctgagagtggtgttcgaactttccgtactgatgagtcaacaggtaaggcgttgtgggatgaatacgatctggaagaggtttgcaatatccacgcattccgtggaaacttctaccataaaacccacatgttttacaataagcgtcgtgctgaactgccgactgttcatccgaacctggctcaccttcgcgttgcagagtggttccagcgttatccagggcaggttgttaacttgaccaccaacgttgatgatcttttggaacgtgctggtgtgccgaaagaggatacggtctacattcatggatacctgaaggaaatcattgtcaaggacaacccgaaaggaaagccggagattattgatgtaggctataacgaggttgatcctgatcagtataaatggtgtaagcccaatgttgtgttctttggtgaatttgcaccagaatacagcaggatgtatgacatccttgacacccttaccaatgaagatatggtgatcgttgtcggatgctcaaatacagtcatcaacttcaactgggagttgtttcctgctgttcgtagaggaacaaaggtgcttgtggtaaacccacgtatcaactatcttgagcaagagcagtatgatgctcatggtgttatgcaattccgttgtggtgctgtagaggctttcagcaacaacaatttcatcaagattgtggaagatcatcttgaatgtaagacagcattacaaggtaaggagaaataatgtcgattgctttagataccccaacactgtacgccattaacaaggacggatcttatcaggtctggaatgttagaacagagggcgatgaggtagttgttgagtttggtaaagaaaatggaaaggtacagcaaaaacgtaccaaatgtgaaatgaaaaatgttggtcgtgctaatcaaacaactgctgcatttcaggctgtgcttgaagcgcgatcaaaatgggagaagcaagtacgccttggttatcgtgagacaaaagaggcgttacagactgaggagaacttctctcccatgctcgcacacgatgcaattaaacgttcaaaagcattagtttaccctgcttatgtgcagcctaagcttgatggggtacgcgcccttgtaactcttgacaaagatggtatcccagtatttaatagtcgcggaaacaagacgtaccctgttcaaggtgcattgttgcagcagacaaaagaacttgcagagcatactgggtttgacaaatttgatggtgaactatatattcatggtctgagcttacagaagattgttgctctggctaagaagtggcgtacacctgagcagatcgaggttgagattgaaaaggattaccaatcagatctgaaacgctatcagaaagctattgacaacggtgagcaagtatggaaagattttgatggtgatgaatacgatgtaagtattgaaccggtgaaagatgttgaccgatatggcggttactcaagtttggaccttgaatatcacattttcgatattcctgtaaacgcaaacagcccgtggcattcagagagccatgataaaaaccgactatctgatcttgttagcgtgatgtattcacttgattgtgaggtcaatgcaccaaaaataaatgttgttcgtggtgagtttgtcctgaatgaagatgcggttaagcggttcattgggcgatacatgcaagagggttatgaaggtgttattatccgcaacttcaaaggcgtgtatgaattcggtcagcgatcttccgaccttcagaaatggaagctgttccaggatggtgaagcgaaggtgttggactctgtggaggacaaaaacggtgagggcgttctcctctgcgaagaaaaagacggaaccagatttaactgtaagatgaaggggacgcgtgaagaacgttctcaagcgagaatgttacttctggtcggtaagttcatcaacttcacattccaagcaaggactgacgacggtgttcctcagttccctgtagggcagagtgtacgagaagttgattcattaacatgggagcctgtatactgatggcattttataagagaaaacctcaagaagtggaagcacatgtgttcaatggttcgagcacaggtgttggtcaagtgacaaagtggatggagactggtgtctggaaagactcagagattcacacacgagacatccgtaacatggatgtgaatgggacccaagcttttcctggtgattatatcgttaaggttggcgaccaattccgtgcaatgtcaccacaggattttagcgacctgtatgaaccagtcacagatgaagaccgtctgcctggtgattacaaggcaaagaatgtcgtaatgggtgacaaggttgaaatgtggggcaaaggatatgttgtcaaaggtgtgaaaaccagaggtgacgatatgatccttgagcttgatgatggctcaaacgtcccggttcgtggtgataccacagttaaagtaatcgaggtacgtgcataatgatctggtattggctggcgctgctgggcgcaacactggttaccgggggcgggatttatctcgcctaccgtctccggaaggataagctcgatgacttcctggattggattgaaggtaaggtcaaacgcctgttgttaatctgggcggttgttctgggcctggtaacgctggcccttaccaaaccgttgtggaacaccatgacctgtcagttcgacggtatggcctacaaggtaaacacgtcttactcttggtataagaatgggacgtatggagataaatgcctgttcgtagcaaagaacggagcgctgctgccattaagaattattcgtgatcagcctgatggtgatcatgcttcagatgttgttaattaaggagaataaatgaacttcggcgtaacttatgaaaccctactgtcaatgacaaaaccgaaagaccttgttgaatatggtcgtcatgtagcccaatggaaccatattgctcgtgtcgctcgcggcggtaaggctactccgattgatttgcaattctctttcgttgaagaagaattcaaagagcttgttaaggctcttgaagatggcaatcgtatcgaggttgtagatggtgcttgcgatctctttgtcgtctcgtcctatgctttctggttgcttgaatcttctggtattcgttgggaaaaagcaatgaagcctgatgggatggtacagttcaacattggtgagatggtagaactcattttcaatacaccattatccattgaatctgttcgtgctgttcttgagcggtctgtagcgttatgctatcgattagatattaacttggactacaatatgcgccaagtgcttacgtcaaacgattctaagtaccctacaatcgcacaacttcgcgatgttcatccaacccttcatctgtacactgatgacgagttgctgactgctgaatgcaaggagattgaaatacgctccaaaggacgttacaactctgtaactgctgtgcgtagtggtgaacatattgtgttcttcgatagtaaaggcaagatcatgaagccaaccactttcgtagaaccgaaaattatcgcttgacaataaagagggggtctatataatggaccccatcaagacagagaggagaaataaattggaaaaagattttgacgaagtttgcaaggaactgttagaattgtcaaaacgtcttaatgttcaaatcgttatcggcaacaggccgacattcaggccgaagcaatatatgatccgcttcacaatgaagcgtcgttggggcggtgtcaagaagtacgcttatgaatgcactctcgaaaatctgaagacgtatgtagagcaaatcgagaaagctggcggaaagattatcggtatcgaataaaagtgtttgacaaaaagatttaaatagctatactgaactgactaaacaaacagaggagaaacaaaactatgccacgtatgcctaaaatcaaagtagaactgaaaaacaccctgccttctgacgctgtagagcgtgagcgcctgaaaaaagttgttcaggaaggtgttgatgcgaagatcgcccaaaaagatgcggcgagccagttcaaagacatcgttgcggttgagaaagacagccataactacgacccgaagttcatcaagaccctgatcaatgctgaatttgaccgccagtatcaggcaggtaaaaagcgtaaagatctcgaagagcaggttgagcagatgaccgaagctgatattctgtttggtcgcgggagcaactaatgaaatattacctgaatggtgttggactttttgttttcttgtgcttcatcttcgggttcgcagtaccgactctggtttcagcaaaggatacacttttagtcatgggcggtttcgcccttgtattctccgccccagttgttgtatggtactggctccgaaaggtgtttattaaacgtggaggggttaatgctgctaaatcttaaagcgtctacgtgggaaaagttgcaggctctggcccgttccaagaataagtctgctgcttcttacgtagcaaagattgttgatgagtacgttgacgaaaacgtaaaaactgaatacaaaatcaaagaggagaaccaaactaatgcttaagaatatcaaacgtgtactgtttgctggcctgatcgctctgggtgcaattggcctgactggttgcgaacgtgccaccgtgcctgcgggttacgttggcgtaaaggttgacctgtatggtgacgaaaagggtgtccagcagcaagaagttggtgttggtaagtattggttgacctggaacgaagagatttatcagttcccgacattcaaccagttgaataactacgagcagccgttcaacttccagaccaaggattcgatgacggtatccgctaaaatcggtgttgaatactttgttgatcgctccaaggtcacgaagattttccagacctaccgcaaaggtgttcaggaaatcactgatgtaaacattcgacagaatatctcggatgccttgatcaaagaagctggctcaatggacattggtacgctggctggtgatggtaagagtcagttgcttgaacgtgttaccaagcagcttaagtccaagcttgatccgattggtattgtgattgtaaaactgtcatataccgatgacctgatttacccaccgcaggtaacagcgtcaatcaacgcgaagatcgaagcaactcagaaagctctgctgcgtgagaacgaaatccagcagaccaaggctgaagctcagaaacagatcgaagccgctcgcggcgaagctgaatctaagcgtctgcaagctcagggcgaggccgatgctaaagtggcactggcaaaaggtgaagcagaatccattcagatgcgtggtgatgctctgcgtaaaaacccggagatcatgcaactggaagccattaacaagtggaatggcgttaccccggtatatatgaccagtggagcacaagccccgttcgttactctgccagcaggtaagtaacagttgacaaaaggcccggtgatgattatcatcgggtctcaacatataaaaaggagatacaaaatgatccgagtaaaattcttcatagcagtattactgctctcttccccggcattcgccacagtcaacaccctcaccttggtggacgaatacaccgatggaagctccaaagtctgcatttacagtgatggtaatcgcacagaatcctttgttaaggatggcgctggttcttgtccttccaaaaagacattccactgaggtgattttatgaaaaagttctttggtctgcttctgttttatgcttttacgatgttgttggggtggtatactggcaccctcctgttcgcatttttcacatggacggccccggtgttggaaatccccggatgggctttaagggttggattcttatgggttctgggtattaccgggttcatgacatggaggggcagaaatgagagtaacggataagtttgttttctttttcacccaatacgatatcttcagtaatcattatcgctgtgccaatcctttctggattccaaagcaccaagcggttggtgcaaagttctggactgtagaacacttcatgatgtatgaaaaggctatgctgtttggcgatacaaatatcgcggttgatattgctaatgtttatcacccccaagaggctaagaaacttggtcggcgggtgaagaacttcgacaacagcaaatgggaagcgtttcgtgaaaatatcgttgtgaatggtctttatgccaagatgatggctaatcccaccattaaggatgcggctatcaagcttcgtaaagaaggcagggtctttgttgaggcatctccctacgatgcaatctggggaatcaagatggctgagaacgacccaggagtagaggacccaaccaactggaaaggtcttaaccttctcggaaattgctggcacaaagcgattgaccgagtaattgacactatggaggtgcattgaaattagagattgaactggttcctaaaacagcttggttcactaacttacgctctcacctctctaagtccaattgggatgtcgtaaggaagaaatgttatgcaaaagccaattataaatgtgagatttgcgggggaaaaggaaccaaacaccccgtagagtgtcacgaaatctgggactttggcaatggcaagatcacgctaaaaggtctgatcgcactttgtccatcctgccacgaagtcaaacatattggtttggcgggtattcgtggtaggggggaaatcgctcttcgtcacttcatgaaggtcaatggtgtctccagacaaattgcagaacagtacgtgaaagaggctttcgctttatatcacgaacgcagtaaacgggaaaaatgggaattggatgtccggtatttggacgagtatttgagtaacgattgagagggctagtgggatatccgtatgataaagattggaaaaataaagtcacgaatgactgtgtgatcgctttagaccttgaccagacttgctttgtgtctgccgctggcgctgagaagcgtacaattaaggcaactcacatcgcttctggtcggtcaaagatctttaaaaacagaacagagttctggggttccaccaagaaggtggttggcggatggttgaaggaccagaacgccaatatggaagtgaaggcgaaagctgaaggccgtgagttcaccccttggggaagagatgacttcttaatcgaagatattcaaacccctgaaccagtggaacactgcctgcatatcctgaagacaaagattaatgctatctttgaacatttgggaatggacagcagcaatggccttggtgtgctcggcggggacaacaacttccgtctgttgttaccagcaccggaacgttacaaaggaaaccgtgaagacacccttcgtcctttgctgttgaaggaaacccgcgagtatgtcaagaagaagtataatgccaaggtcattgatggtgttgaggcagatgattacctgtctgttctgatgtataccggatgggaacacttccaggcgactggtaagttcaactacatggttgcgtcgttcgacaaggaccagaaaggaacaccgggtttacttcttgatacgatgcgtgatagcgaggagaaaaactggaaacacccgatcccgatgattatcgacgattctatgggtgagatctggatggaaggaaacaaggtcaagggatggggacgtaagttctttggctaccagatgctttgcggggacagttcagacaatatcaagccttatcaatgcttcgatatctctgggcgttttggagatactgctgcattcaacctgatcgggcatcttcagaacgagaaggaaatgtggacggcaatcgttgaccagtacaagacttggttccctaatggggttgagttcacctcttgggatggtttacagcgcaagatgaccgcagggcaatgggcttcaatcatcttccagatggtttacatgaagcgaactgccaacgaccatactacgctcacaactgaacttcgtcgcgtgggggttatatgattgataagatgatcatggatgctgtaatgagggacacccaggccctctccgtgtcctctctgaagccaaaattcatggttggaacagggctgtggagaatgctggaaacagatgatggggactatgttgtcttcacggatgacttccttgaccctgataaggcattcactgtgcttcttctggaggattgtgagcttgtggagggggagagattagttctcctgacaagcgtggcttatggagaccttgagtgttctctggtgttgttcaaggaccaagctgtaggagactccgatgaagttgatgtcggttgaccaaagcctaagtcactgtgctgtcgtaatatgggaacatggagttcccgtttacagggaaatgatcaggacaggctcaacacacagtaaagggaagaggcagaaggatgttgtttattttgacaacgtttatgagcaaatccgttatattgtgaacaagataacaaccttggcagaggagcacagaattgaccactacgtcatggaagccctcagtcttggttctatcggtagtgcaactcgtgatttggctggccttttttactgcattgtgtacgcattgtaccagtttggtattttagggtatggttcaatccacactgttgcaccaacatctgtgaaatcttttgcaagaggtcttttaccggaagaagagcgcacttttgtgaaagaaaaggttgacaaaaagacaggtaagaaggtatactcaacgggccaagtgaagatggaaaaatcgcatatggtcagggctgttgagtgcgacatgcctggctggttagacggtcttacgctcgcggctggtaaggcggattatgcggatgcgtatttgatcgggaagaagttcatggagggagtatccgtagaaaaagggtaaggagtcctgcatcaaaacccaaggcaaggaagaaacctgtcgtagtgccattgacgccaggactttgggtaaaagatgcaagacaaatcgctgcattcagggagaaattaatccttgagcaggggggtcttgatcctgtgcttggggagccacttcgcaaaccttgcttggaccatgaccacttcgatggtaaatgtcgtggagtcttgagtcagtgtgtgaacaccttcgaaggatatgtgctgaaggcatggatgaagtacgtgtctgcgtacacagatacgtctttgtccacagcgctccgaaatcttgctgactatttggaacaggattttagcgggttccctatccatgctgcgtacaaagacgatatgctgaagttcttgaggagatgtaccaatgacaagatcattgaaagggcggagactgacctcggcctgatcatccccaaaggtactcagaagcatgatagcataacgctttaccttacagagtttgtcagacaaacggaggaaagatttgctggacaatttgagcaagcccctgaagttctattacaagaactggcggggtgaatacggttatcgaaccgtgatggacccgattatgtggttcggttccacagagtatcacaaagagccgcagtggatgatcaaagcatacgatgttgagaaagatgccatccgtgactttgctgtgaatgatattgttgaatttatccgagaggtgtaatgctgagtgcagaagaaatccttgaattaaaagcgaaaggtatgagcaaccgtgaaattgctcgtcgttatctggggaaagagagtaaggaatctcatatccgtctgatcctgaaggcgcaccagtatgatgcagaggctgctcaggtgatcaccgagacagttgttcgcaatccgggcgcgaagatcttccttggtgacgtagaggtatcaccaacgctcgcttgggtctttaaccgattcaaggcgtttgtaacaccttcccacgtagaacatgagccttatatgtacacatgggcgggtaagtggttggataaccctgcgattatcagtcgcaagctgccggattatgagacgttcaaaaccgatatccacgacgaccgtgaactggttgaagaactgtggcatatccttgatgagtgtgatattttcattgcacacaacgcacgtttcgacaaaggatgggctaaccaacggtttgctttccacggtatgaaaccgccgtcaccgtacatcgtgatcgatacacttgcagaactgaagtcggctttctccctgccgtccaacgctctggaggccgcgtgtaattacttcgagcttgatgcccgtaagcgccatcacgaagggatcaccttgtggattcgttgcttccacggtgaggttgcagcattcgaagaaatggagttttacaacatcggggatattccgacacttgaaggtatctacttgaaagttagacctttcatgaagaaacacccgaacgtgacgctttataacgaagaagacgacaacactgtccttcgctgcgttcgttgtaactctgataaggtactgcctatggaaggtaaggtggggacaacctacctgtcaaaattccaggcatatcgctgtgaatgctgtggttctgttatgcgtgaccgtcgcaacatccgtaccaaggaagagatggctaacacgcttgtgaatatcatttaagggcttcggcccttttgcaaaggagagaagaatgagtagagttatcagcatcaaagtccctgactcgtttgataatgactggttgataaagcagcttcgtgatcttgacatgcgtctggaggagttggttgaatcggaatctgatgaagagcgctttaataagatcggggcctgtctggacatcgttaacgctatgcaagaatatgcggggtactgatggatattatcgttctgaatgcaccgccgttgagcggtaaagatgacatctccacctatctgtgcgatggtcacccaaacctgcaccacgaggaagttaaggaacttctgtttgaagtggctgtaaggactgctggcatctctcgcgacctgtgggatgctatgtacactcgtcgttacaaggaggtccccagtccctacctgatgattgatggtgtgaatgtatctcctcgtcagtggatgattcactgctctgagaaggtgatcaaaccactcttcggcaagtctgcgtttggcaaggcagcggttgaaaaactgaagcagaattatgcgaacgatgaggttattgttttttctgatggtggtttcccggaagaaatccgagagctttctgatcacgcttatgcaactggtggtgagtttttccttgcacgtattcaccggaaaggctatgattggggtaacgacagcaggaactggttataccttgacggtattcgaggtcatgaaaaagacttcgataacaaagagggtaagttgactgactgcgccgaatctgtccttgagtgggcgagatcaatcagctatggagaagagaatgcgtaagccacttaacatcggtattgatgtagacctaacgttcgtagattcaggcacaccctggcttcaatggatggagcaggtatacggtgtaaaggcagattataacctgccggatataaacccgcaggggatggattattataatctgtcaaaatacttccctcctgcgaaggttaatcagttacctccgtatgagttttgggaagatccgtacctgtacgacaaactgcgtccccgcgccggggctgttgatgcagttgcaggttgggcggctgctggacacttcaaccatttcgtgtcttactgcaagaaaggccatttctcgtccaaggtaagattcctgaaacgagagacagaggagtttttcagcattgaacctggaagtggtcacggtttttatgcaacaaaaaacaaagctggtattaagattgatgtcatcattgatgaccgtaatgagttcctgaaccagtttgggccagaggtgattaagatcaagttcaagacaccttatgaccaatctgaagagcttcgcgtctctctcgatcttgagagcgatgactggaacgtcatcaaagacttcgtgctggatattgcttaatgaagagatgccccacaggagacttcgttgtccactatggggattgggtggaggtattcaccgaggacggaaccttcctcatatccttcaaagcaacaagtgacatgtgtcaggacatcctgacacgatatctggtgtttaaagccgggatggacccggaaacaccttaccgaatcaagaggagaggcaaatgagtcttaaaccagaatctttcgacatcatcaaaaacgaacttctgcgtcgtgctgaaaaaatcccacaagtgctcggccttgatgctgtagggatcaatgcagcagaccttgggatcaccgaagatttcgtttcccgtctgatcactgaggcataccttggaatattcaccaccgacgaggttgaggaaatggtagccttccagcaaaaattcgcagatcgcaatctcattcttgagaaagttattgagcaagcatttgctaaagttttagaagaaaacaaagagtcgctgtataagaaactggaaggagcacaataatgaaaaaagctgtagttgcccgtgttgtcgcggatagtatttcaccgcagggtcgccgtattacaacttttgagcttgagtaccctcgtatcattcacagcgaactgatgactcaccgtctgttcagtcggaacgctatgagtagccgtgcaatcccgatcaaaaagatgatcgagcaggttcagacagaccctgcaatgccagttaagtttggaaagaatcaaccaggaatgcaggatgctggtgagcatgacgcacagcttggtgatgggtattcggctgaagattggtggaaactcgcaggattaagtgcggcacggtttgcagcagaattcgcagatgctggttaccacaaacagatcgcgaaccgcctgcttgagcctttccagcgaatgaaaacggtcttgacagcaactgactttgagaatttctggtggttgagggtagataaggatgccgatccaaccatctacgctttagcagaggccatgaaaaaggaatttgacgaatcagtacctgaatatctgaagccagggcaatggcacaccccttatgttgatcacctatacactgtaggagagcaggcaagtgaagacacatttgattactgtgttcttgacgagaacaacaaaccagtgatcttgacagtggatgaagctaaggctatttctgcatcttgttgtgctcaggtgtcttatcgtgtgcttaacaacacgaaagagaaagctttagacatttatgggaaacttttaagcggtaataaggtacacgcttctccttttgaacatgttgcaaccccgatgaaaggtgagttcagccagtacggttatgacccaagcatcaatttggcggaatacccagtttcttgggaagaaggcattacccatgttgatcgcaaaggtcgcctatggagtgggaactatcgaggctggattcagttgcgtcaattactgcctaataactatgttgaaggttgatgtagctggatatgaagggatttatcaggtagatactgatggtaatgtttggtctcttgaaaggtgggttgagaaaactcgccacggaaaaagaacagcgccacagtttgtccctgcaaagaaaagaaagtgttctgagcatggcacaggctatctgactgttagattggcaaacaacggtgttgtaaaaactttcagggtgcataggttgattgctgaggctttcctacctaacccactcaacaagccatttgtgaatcataaagatggtgataagagaaacaacaaggtctcaaatcttgaatgggtaaccgagaaagagaacactgaacatgctatagaaacagggctgaagcctgaaaatctgagagatcccatgactgggcgttatgtgagcgaacaactggaaataacgtagtttctggttgacaaagtttccagtaatacgtatcttggatgtatgaattgcggggagaaaatactccccgattataggcagaatggagattacatgagtaaaacaaaacgcaaaccaacccaacatatttcggtcactttggactttctgagaaccgtacccggattcgatgtaacccaagatagtggactccgtgctgccctttatgcagtaggcttccaagtcaccgatagtgaagggaatcctaagcaagtaacaatgcttaacatgaaaaatgtacgatgtgcgaatttgccctatacgtaccgtaaaacaacaatctttgttggtgacatgcgtccggattatccgtatgcaaaaatttataacggtgttgatattctcgacgtagggatttactccgagcgcgacatggagttcgttcttgatctcccatacgatattccagtgaatgagaaggttaatacccgtaagtacaccaaacgtggagatcgtccagattcgtttgatattacgttcgatagtgaagatgaagcacgtctcagtgacgcatttggtctgggggaataatgagtaaagagaagaccaagtggaaagaccgtggcttcgatgacaagcatcactacgccgggtggctctacttcaatgatttaaccgatgacagcaagatgtacgacgatgtttactatgatgagtattctggtaaaatagttaacgtcactacgccgggtcaggatgataaaccagacgaagacgttgacgaagctgataagtatcttgctcaattcgaagaaaaataaggagaaagtttgatcaatacagttgtaaagagtgatggaaccaaggtgccgtttgaaccagaacgcctgaacaaggcagcgatctttggtgatgacggtaatggtaactggtcacatatctctatggacgcctacaagcgcctgtatgatggttgcaccactcgtgaagtaaaccaagcattgatcgatgcctgcgtgagccgaaaagacgaagcccattcaaggatggctgggcgagttctgatcgggcagatctacaaagaagcttatggcggtttcagcaagatccctgctctttataatttctatcacgagatgattgagaagggttactgggaagacatgggttatggtcagatggagttggtggaacttgagagtgtcattaatcattccaaggaccttgactacggctacgccgtcctgaagcaattccgtgacaagtacggtatcaaagacaacatcaacgatgttctttttgagtcaccgcagatgatgtttatgggtattgcgatggcggtaatgaagcgtatgcctcgtgatcgtcgtatcaaggatgtcattaagctttatacgtatctgtcggatctgaagatcaatgctccgacaccgtatctgaacggtctccgtaccggacgaactggatatgcgtcctgctgcattatcaaggctgacgatacagcgaaaagcattggtgttgctcgtgaagttgcgtatacgatgacagttgcacaggcaggtattggctactacctctcctcccgctcaattggtgacggcgttcgtggcaatacgatcaaacacatgggtaaactcccatattaccgtggcattgatgccggggtgaaagaaaaccgtcagtccacccgtggtggttctgctacgatctctttcctggcccttgacccgcagatcgaagaactgttgcgccttaagaacccgcaaacagtttcttcaaaacgtattaacacaatggattactccattggtattaaccagtcgttcatgaaccgtgtggcgaagaaccttgactggatgctggtatcttacaaggacgcacctcaactacacgaaggtatgttcaagatgaccatgcaggaatttgatgcagaagttgctcgtgtggcagcggatactaagatccctaaaacttgggtgaaggctcgcgatctggcactagagatcattacccaacgagcagaaacaggtcgcctgtacgtttactggcctgacgagatgaaccggcacacgcctttcctggagacgatttattcctccaacctgtgccaagaaatctgtctgcctaccaagggatacaaagatatgcgtaacatctttgatacctttgcagacgatggtgaggtcgctctttgcttcctgtcatctctggttgctgggcgtgtttctccggaagagtacgaggatgttgcttactacaccgttcttatgatcgacaacgttatggatatcatggattatccgtatgagaatatggaacacactgccaagtctcgtcgttcaatcggtgttggtttgacaaaccttgctcattacattgcgaaacacaaggttgcttacggctctgctgagagcaagcagttggttcatgacctggcagaactgcacagcttcagcttacataaggcaagcctgcgtcttgcaaaagagcgtggtgtagctccgtggatgaacaagaccaagtacccacaagggtggttgccaatcgacacctacaacaaggcagttgatggagttgtgaagaatccaagtctcaagcaggattgggaaactttacgacaagagattatcgaagttggtggtatccgcaatagtgtgttggaagcttatatgccgaacgaaagttcttctctggcgacgaacactactaacgggctttacccggtgcgagatcacattatcttcaagaaatcaccgcaagggtctgtgctgtttatcgtgcctgagtatgaagaactgaaggattactacacctctgcgtgggatattaacaccaacgacctgattgacatttacgccgtcattcagaagttcgcagggcaggcgattagtgctgacctctacatcgactatacccagttgaaagacggaaagatctcgatgaaggaccagatcggttacctgatccgtgcaacgaagatggggatgaagacttggtactacttgaactcgaaggttggtgctggcgactcactcaccgcagaacttcaggcgaagaagcaagcagaggaagagacccgcaaggattatccactgattgcagacacctcggttgaagacccgtactgtgaaggttgtgcattgtaattcttatggggcttcggcccctatttttccggaggcgaattaatggcagtattcaacgctgagaacaccgctcataaaactggtgattatccgctgttcctcggacagcaaatgggtctgtatgactccatctacaaaaaatacccagccctgtttgacctgtacaaggctcaaaaggaacaggattggtctgaagacgaagttgagctaaatcagtcaatcactgactttgcaacctgtagcaaatccacgtatgatgtcatggttcagaccctgatgtggcagtgggaggcagatagtgttgcagcacaggcgatcatctgtctgtttgcacctttcatcacaaacagtgaacttttcgccatgatgatgaagcaatctgagatcgaagttctccacgccctgacttattctgatatcgtccgtcagtgtttgccaaactctcggcaaattattgaagatattcaaaacaatcaggcagttctcgaacgttctggtgtgatcgtcaagtacatgcgtgaacttgaagttcttggagcacattatcgtctcgatcctgagtctgtagacaaagaacaggttcgacgttgtatcctacgtgcattgttcgcgctgatcggtctggaagggattgaatttatctccagcttcgcgtgtacctttgccttggcagaacagggtgtgtttgttcaggtcggtcagcttgtccagaaaatcatgctggatgaaatgctgcacaccaagatggatttcgaggttattgatatccttctgaaagacccggtgtggaaggctagttttaatgccattaagcacgagatcaaggaaatccttgacgaagttcgaacaaaagagtatggttggggtgattacctgttcagtgatggtcgtgcaatcatcggattgaatgcgccgctcctgaaagactggactgactggaactgtgctccgatttatgactactacggtattccaaaagatttcgaagctcctaagcgcgatcctctgccgtttatggatatctggatgaatccaagccgtcagcagaacgcaaaccaggagcagacaaacacggattatcgtttaaatgcggcagtcaacgatacagacggtgaagtctgggacttttaaggagtaacattggacaattcgatttttgatttcggggttgcttacgaccccaccaagattcatgtcactttcgatggtgagcgtattatgggcctggattgtgatgtcaaggtttcatgctctcgccgtctgaatggtgtggcctgtgctaaggtctttattcaaggtcaaagcccttgggttgtccgactgaaaaagcttctgggtgagcaagggcgattgcaacttgagtacaccggaagtggaccattccacgacagttgtaactttgtggctgatatggttgtgaaaggttatgacgttgattatactggcaacatcccagtttttgtttttaccttcgaaacggagaaataatgagtatcaaagacaacattttcattatctacggcaaggacaattgccaacactgcgtccgggcaaaagagttcgctaaatccaaaggtctggagtttatgtatctgaccttggaaaaaaactacaccaaagaggaactggtggcaaaatgctctccagtgatcccgacaaccgtaccccgtatctttatggatgatgaaaccagcacccggtacatcggaacagccgatgagttcattgcatacgtcaatgcaaacatctgagggggtagatgagtgaaagtagtaaaacgcgatgggcgtgttgaagacttctctctggaaaaagttaaacgagcggttgaggccgctctgttagcaacaggtatggacccagaagcagcacatcacactgcggtccgtatcggtcagaggactttcaagctattcatgacgacacctgtgagacatgttgaagatttccatcgtgaagtggaaaatctgttgatggaagaacctctactccgtgacgctgctcgcgcctatattgagtatcgccatgatcgtgacaacgcgcgtgaaggaaagggaaaactttatgcagatatcaccggattcttggaccaatccgcagaagagttcacccgtgagaatgcaaacaaaccaagcacggtcgtaaacacgcacagggacctcttagcggggattttgagtaaacatgtggcattgacccagatactgcctaaaaacctcgcagaatggcatacagagggttttggacatattcacgaccttgattacctggtaagccctctgacaaactgttgcttggtaaattaccgggacatgcttgaaaatggtttcaagatcggcaatgctaagattgagaagccgaaatcaattggtgtggcaaccactgtattgacacaaatcatccaggctgtagcgtcaagccagtatggtggacagacttgtgctcacatcgacgaaggtctgaagcaatacgttgaaatgagcttcatgaagaatgtgaagcagttccagagccacaggaacgccgttggtccgaccaacaaaatggtttatgatgcaatgcagacactgctttatcaggtcaataccctgatgagcgtaaatggtcagtctccgttcattacgatcagccttggtttggatacatcaatgttcggtaggatgatcacttataattatctaaaggtccacaaagagggcctcggcgctgataaggtgaccccagtgttcccgaaagttgtgttcttcctgaaggaaggtgtaaacatgaatcctggcgatccgaattatgatctgaagttgctggctatggagtgttgtgctgagagaatttaccccgacttcatctcagtaccgttgaacatgcaagtgaccggatcttcggacggcaaggtgacgagcatgggttgtcgaagctttttatctcactttgcaaccgaaaatggagaaaagtacgatggacgtttcaatcttggcgtggtatcattaaacttacccatgattgcagccgaagcaaaagccggaaaaggtttcttcacagaactgcttgataagcatatggaaatggcttatgaggcacacatgcttcgtgttggtcgtctgatggatgttacggcatcccagaacccgacattgttcatggaaggtgctctggcaaggctcgggcctgatgagaagatcagtaaactcttctatgacgggtacgcctccattagtatcgggtttgtcggcctttatgaggctgtggaaatcctttatgatgagccagtacgcaaggagatggcgatgaatatcctgaagtacatgaaggatatctgtgcagagttcaaggagcgcagtgggttaggtttcagcctgtatggaacacctgcggaaagcctgtgttatcgctttgcaagcaagttacaggagaaacatcctggtttgattgaaagagattacctgacaaactctttccaccaacctgtgtggctcaacagcgacccattcagtaagtgggattacgaatcaggtttcgcagagatcagtaacggcggtaatatcggatacgtggaaaccccgaacctgaagcataatatgcaggctcttgaagcgcttattaactatgggtacgagaacattcattatttcggtatcaatcagccagtggatcagtgctttaaatgcggattcagcggtgagttcaaggcgactgcaaaaggattcgaatgtccttcttgcgggaaccatgaagaaggaacgatttctgtgattcgtcgagtttccggatatctgtcagcaccaaactcacgaccctacaacaagggtaagatggaagaggtgctgcaaagggtgaaacacgtatgaatttctgtggttatgaaccaacagacctcgtgaacggagagggggtcaggtgctccctttgggttagcggttgcagtcacggatgtcgtggctgctttaaccaaaaagcttggtcgtataactacggtcagcctttcaccaatgcggatgttctcaggatcatcaaagatatgggaaggccatttatcaagggcttgtcgatactcggaggtgaaccacttgacccgcaaaatgttgatgaggtcgtaaaagttatcctgcgtgtccgtgcagtattcggagatagcagggatatcatggtgtggactggatacaccttcgaagaagtccctgaaagggttaaaaaacttgttgacattataatggacggcaagtatgatgagtgcaatcctacaaccaaaaggttcagaggttctgacaaccagaggatgtgggtaaaaataaacggtgtatggatagaggagaagtagatgagtaagaagacactgcgtaaggcataccagaaagaactggcactggaactccgtggcaaaaagcgtaagaacaagcgcaccactgaagacgaactgatgcaactggtagctgacgctgctgcccgtggcaactactgaggtactccatgactgacgttatcaacgaagaacagacctttgtgccacaatcgcaactggaaacgctgctgctcggagattcggaggaactggcccgtgagtttgtgggccttgttttcccaagactgatcaatcagtttacggaacaaactcagtatcaaattgaagccctaaagcaaatgaaggctgacgcacgtaaaggccaggatgctgcgatggagaaagagcttaatgctgctcaggttaagctgaagaaagctctttctgaagaggttatgcagaaggtgatggatacgatggttgaccttctgaaagaagcgctgacaccgcacgagcttgcttacgcgatctaccaagaacgtatcaccatcaagatttctgggattgccgcccgacttgaaacggcttttgaagaggcgctcggagagggctaatccgaaaggaggtcttcaatgaatgctgcaattgcggagattcagcgtatgctgatcgaaggtgggtttagcgtcggcaagtctggtgctgatggattgtacggacccgctacaaaagccgcactgcaaaagtgcattgcacaggctaccagtggaaacaataaaggaggtactttgaaactcacccaagcacaactggacaaaatcttccccgttggtgcaagttctgggaggaatgcaaaattcctgaagccgctcaatgacctgtttgaaaagacagagattaatacggtaaatcgggttgcaggattcctgtctcagattggtgtggagtcggcggagttccggtatgtacgtgaactcggtaacgatgcctactttgacaagtacgacactggtcctattgcagaaagacttggaaacacaccccagaaagatggggatggtgccaagtacaaggggagaggtctgattcaggtgaccggactcgcaaactacaaggcttgcggtaaagcactcggtcttgacctcgttaaccaccctgagttgcttgaacagcctgagtatgcagttgccagcgctggttggtattgggacacgagaaacatcaacgccgcttgcgatgctgatgatatcgtgaaaattaccaagctggtaaacggtggtacaaatcaccttgccgagcgcacagcctattacaaaaaggcaaaatctgttctaacctcgtaaggagaaccaatatgggaagaagcaaagaggctcgtgcattaaaactttcggctcgtcagcaacaacgtgcagaaagacaagcaaagcaccacccgaaattcgatgaggaacgtaacagcgccccggctctggttgctctgaatgaaaagcagcaggattaccttcacaaattgcaaacttgcaatatcatcattgcgaaaggtatcttcgggacaggtaaaacctacctggcatccgcccacgctgccgacttgctacgtagaaacgaactcgacaagatcattgtcgctcgtccatacgtgcagacgggtaaaacctccggcttcaaaccgggtacttcactggaaaagctgttcccctatgttcgtaacatgttggataccatccgcaagcgcatgggcgacggggcatattacaatgctctgaaagacggtttaaatgggcgtatcgaagttcaggaattggaaagcatccgtggtcgttcattcgacgaaaagagcttcctgctgatcgacgaagcccagcagagtaccccagaagaaatgctgagtatcattactcgtatttccgataactgtacactcgttgtgatgggtgatgccagtcagaaagacatttatggtcagtctggcctggagtggctgattgagtttacccagcgacacaaccttgcaggtgtgggtactgtgtcctttgatgacccgaatgaggatatcgttcgtggtggtatggttcgcgacatcgctcttggcctgatggctgaccgtgacgcaaaactgtacacgccgatggcttcttaacaggaggaatatggcatattatactggggtaggatcacgcgaaacacccccagaggttatcagcgtcatggaagacgctgctttccgtctcgccaggctcggattcactcttcgaagtgggaaagctggaggagcggatgctgcatttcagagagggatgcaaaaatatgacgaaactcttgacaatggaaagaagaaagagtatcgtacacgcttggcagagatttacatcccttgggacggctttgcttcagacaatgaagacctttgggacttctgggattatcccttgagttaccttgatcatctcatgcctgaacaaaagcataaaagggatcagttggttgaggaaatccatccgaattatgaggctctgaaaaggaaaagaggtgcttttgcactccattcccgtaatgtgcatcaagttctgggagcaaacatccttgatccaaagccctctgccttctgcctttactatgcttcggaagataagcatggcaacccaaaaggcggaactgcaacggctgtcaatctcgccaaaaagtatggcgtgaggacgcttaacctaaacactccggagcgcttggccttgcttgagcagttcctgaccagtcttgagaggaaacgaggtgtccaggtttagagagaagctgaatcagtcctactgccttgtgaaggttgaaagaaagggctgggttctggctaaaaagacgggaaaacggatttatgttaccgaagcaggtggggagattcgttatgtttgcaccacagatgacacgaatcagttcaaacatctgactgaatctctagagtacgagtccaagaaaactcttgtggtcggagatacagtaaagctggacaatttcgggctgttttacattgtggatgcaggataccgtggagatgacggtgaagttaagtacctgatagctcgataggaggagtatgacagttagtattcatggggttgtttcccatcgaaaacttatggaactgaagaattgtggtgttgtcgagcctgaatttttcgaggaagaagtaacgaagcttttcaccttttaccgtaaggtaatagcacagagtttgtacgagatgaatgatgggtttcttactcgtattatctacagcgaaaaggtggctgaacgtgatgctcgttggatgtttccggacagacgtgatctacttaatcatctgatttatctggatcatcagggtcgtgaatcgagttatgtgaatatcagtccgaaggaactgaatgagttcacattgctgcacacagcagcgttagcctctgagagggcaagaaaagttctcgtgacattcaagtacagcgatcaagtgcttgtggatgacgagacagggtactacattgactggctgatgaagaatgcttacattctgaaaggctacattgcaaacgctcgcgaggaggattaacatggaacagaacaaaaactttttcggtatgctgccggggatgagtgggaacatttatagctacccggtccactctcacgatcacgtcatctacattgatgatctgtcatggctggaagaccatcaggatcgtctgcaagttatccgccaggcaagccctgatgacacgatccgggtggtgattaacagtcctggtggggtagtttctatcgctatggcgtatgtcagtgcgatccgtgagagtcaggcacagatcgtcacccatgccgaaggcaacgtttgttctgccgggacagttttgtggctggcctgtaaggatcgcacagtgtcaccactgacagagttcatgttccataattatcagggcgggactttcggtgatggtgcaaacatgtacgctcagattgcattcgagaagcattattttgatcgtctgatcgacaccttctacaccggggttctgaccgatactgagattgcaaccatcaaaggtggtggtcaggtgtggatggatgagatcgagatcgttaagcgtaccactgcggtgctgttggatgagaaaaacatcaaacgtatgcagcaaggtcagaacccaatcatttccggggagaagaaggctaaagaggagaaaaaggtcgttgagaatgttgacctgaacaacctgccagaaggtgagcctgagagcgtgtttctgaagattgatgttgacggggaaatgttcaagttcgatgtatccacgctgagtgcaaaagattttgatgccttcaatgtggaagaactgcaatccatcctgtctcagatcggtgcgctggcagcaggctctgaagaacctctgaaggttaccactcgaaatcgccaggaactgattggtgaaatcctcaaagcctctgaggaaatcgttgcaagtattctggagcaaatggggagctaatgtctgcacctttaaaaaagaaggaagagcgcagggcatacgatgtctacgaaaccccgacttgggctgttgaggcccttttaaaggttatcccgattgattacaccaaaacttacttggagccttgcagaggctccggtaggatctacaacttcctgcctttgggaagcgcgtggggtgaaatccgtcagggcgtagattatcttaacaccgagtacaaccacgtagatatggttgtgaccaacccaccatactctttggcgcaagagttcgtcaccaaggcacttggagaggcggatgttgtgatcatgttgttgaggataggattccttgagagcatgaagcgttgggagtggtggcaggagaacccaatcagttctcttttggttctttctcaaaggccatcatttacagacgatggaaaaaccgatggcagtggttatgcctggtttgtttgggacaagaaaaacaagctcggcctgaagccattttatttcctggagggacagagtgacgaatgtcgcaaacaagatgcgagagatcgcaaacaacggagaaaagcaaaccccggagtcactgaaggaactgtacgatcagatagtggacgggatagcgcagtgtgcgaggaaggggatgtacgggatgggactttctctccagttcccggaggagatgaatgattatctgccccatattgttggcgatcttcgtggtggcggtttcacagtcgatatcatcagctaccaaccaacaaaacaaggcactgcaataaactttttcgtaacatggtaaataaacccgcttcggcgggttttttcgtttttgtacttgacatggagaaaataaacacttaagctgttttccaacagaggagaacaacatgcgattttacatttactaccgtcctttagagaccatccgcttcggagaatacatgggtgaccttatccatatctcgacagaggagaaggattactgccctgacgggaagatttggaaagttcaacgttgcaatcgccctgagagtgtgtatactcgattaatcaagatgttgaaacacggcgggatggaggacgatatggtttatccactcgacggaaatagatcactaaaagatctggtcaaatacatgaaccaatgggagaacaacaaatgaaacaaagtcttaccaaagaacaggccctgatcatcaccgggttcacaggaatcctttgctgtccgttcaacctgtttcacgaagatgtcgaaaagcgcctgggccgatccgtatggacgcacgagttcggcagtaaagagttctccgcagaactgaaggatgtttatcgtgaagacttcatggcgacgatttacaaaggggaatgatgatgaccgaactcaatgcccgtgaaaagcttttggcgatagctgattggctgggatggcaaaacgaaaacctttcatttggcttgaaatccccagaggacgctgttaagctgtacaactactggcaggaacatgcagacagtctcccggaaatggcagacgacgagcaggacgatgagggacgctggttgtttatgttccgtaaggcagcactgggttatgacccgatgggccacgacgcttctattttggaagcccttggggaagaaaagtacgacgctgaaaataaagacaccgacatcggcttttacgacatccgacaaacagtgcgtaaaatgtacatcaccgatgcagaatggaagttacaaaagcagtacggccttgtctaaactgaaacaaaacaggagaaaataaatgattaataaaacatacaccgttgttaaagacctgtgcaatgagaacatggggacaccctccacagtgggtcaggtggtaaccacaattgtggaagttcctgctgataccgctgtagttgtgttcgaccaagaaggccagttttgtttcacctctacagtccgtagcgatgtatttcttaccaaaggtggaaaatccagaagcagagatgggtttggtggtggaatcctaaaccgaatttttgctttccgtatcaacggtgtttggtatgaaggcaacgatgtgtacaccgcagaagaactggggatcaccgaatgaatctctatgcaaaattgactgacccccagaatggttggaatgacgacatggaaaaggcccgtgaatttttaaaaactcacgatcaggaagaaattcttcttgttactgaagttgctattgacaggtcgagcaccgaagtggtattgtctaatcacgggcatggttggaacagtgtgcaatttaccttcttcattgagggtgagactggtcttgaagagtatgacatcttcagcaacaagaaatcattaagacaaatttataaaacatatattcacgaagatttctaaggagaaaagatgaaggtatatttggtaggtggcgcagtacgtgacggtttgctgggccgtgaagtccacgaccgtgactacgtggttgtgggtgcaacacacgaacaaatgattgaaaaagggttcacccaggttggcgcttccttcccggtatacctccatccggagaccaaggaagaatacgcgctcgctcgaactgaacgtaaggttggaagcggtcacaaaggttttgagacctttttcagccctgatgtaacactggcagaagacctgtctcgtcgggatctgactattaatgcgatggctcaggatctggataccggagaaatcattgacccgttcggtggtcaatatgatatcgaaaagaaggtcctgcgacacacaacgttggcgtttcttgatgatcctctgcgtattctgagagcttacagattcaaagcgcagttgggtaaggaatgggatctccatccggagaccaaatctctttgttaccagaaccgtcacgaacttgaaagtatcagtggcgagcgtaagtggaaagagatggaaaaggctcttgggtctgataacttccgttcctatgctgaagcaatggcagaactgggcgagttgccagaactggaatcgctgcgtggtgtagagcaacctccggaacaccatccggaaggtgacgcattcatacacacattgctgtgcctagatatcgcagaccagtacgaggcaaacccatacacgaagtttgcagtcctgtgtcacgactttggcaaggccgtgacattctccaagtatgggaacctgctcggtcatgaagaggcagggcttgctccggttgatgcactgtgtgaacgtattcgtgtgccaaacgatttccgtgacgttgctcgctacgtgactgagcaccatacgcgtgttcattgcatcgcccctcgtggtggaaacaagggtgcaaaaccgcgatcactaatgaagcttttcgaagctgctggtaacgtaaagagcatcaagacagctatgaaggtcagcgccctggctgacgcatgtttctgtgatgcaaaaggccgtggcccgacaaaggcagcagaaccttacccacagggctacgttctgatggatgctttccggtgcatggtggcggtagataccaaagtaatctccgctgaaggtttgagcaagggcaaaacagggattgagatcggggaaatgattagggtggcacgtatcgacgcaatccgcagcgtcacacagcgtcaaattgcctggtaaggagttctgtatgaagaaatcggataaggaagagtacacatacgagaaacatcacttttacgctgacaaacacgcagggaagcaggtttgtgcatggtgcggcctcgtggccttaaggaacaaggcaagcgactggtgcgtggataagggatgcaattacgcattgcatccatcgtacagaagcgccatgtttaagttcacacaatttttcaaataggggaaaaataatgcctattgagcttgtaatttatttgtgcattggtatactggctatgttgacgattctggcgttggattggttttgtatggataagataagttcatcatccgtcggcatcgggctgctgatgatcgtcttttggcctctcggacttttctgtttggtgggtggcaccattgccgccatttttgaagaagattttgttattgcaaggagaaagaaatgaagacacgtatgtactgcgtggtaaatcaatacattgctggcattcacgcaggtatccagtcagcacacgcgatgtctgagatgttcttggattactctcaacgccggaacaatgccggaaacctgttgtgggattgggctgaccgcgataagaccgtgatcgtcctcaatggtggataccagtcgtcattgcaagaactgtgtgagaagttgaaacctctgagcagcacttatccgtgggcctctttctgtgaagaacaggatgcactgaacggcgctatgacagcagtagctgtggtattgccacagtacatgtatgacccgcagtattccgatgtggtcaatctgtaccaacccggtaagtacatcgcccctgtggtagccaaccagtaccgcgatgaaatgggaaatgtggtgcataactacacacaacctgaaaaagacctgatcacaatgatcaaatcattccgactgaaaggagaataagatgaaagtaagtgaacttgaccgcagtgtgattatcgagatgatccgttcagctacgctgatcgctactactgagatccgaactatcgggtcagattacaaaaagaatacgaatttctttgacctcgccctgcgggatgtggtaaaaggtgttgaacaacaactgttaaaggacgccgaataatgatctacacaatttataccctattcaccctgcttggtgtggtattgctgacccgtcactggatgagcggggaagatttcaagatggaggcaagaagtttctccatgttcgtctgccttgccgttatcgagggcttgatgatggtaacaaccctgatcccaccttctgctgggctgttcgcaggaatcctgtttgggatttggatgtggagacatattttgtctgcccgtgcaatcttgcaggagaaagtaatcaagaacgaaaagatgctggtatccatcggcctgaatgttcttttctttgtgcttgtatcggtgagctacttgagctaaggtggataaatgaaagacgttcgtggagaggacttgaagattggtgacgaggtttatatctactggggaggcaatgaattgcgccctggtaaggtaaaccaaatcaagggaaataaggcgaaaatccttgttgattcttggcctaatcacccagatccagcacaccgttattccatgtcgaaatggaagtcgggcgagtgcatgatcaaggcagaagagccaacaggctggtatccggacgaggtagttttattgattcaggagatcattcgtttgagagacgaggcgaaattcttggaggagaagatcaagtaccaagatctcttgaatttctgggataaaaaccgaccatccaatcttgtttgctcttaaggagaaatatgaaaactgtagacttgatgcgttgctactctggcagcatcgcttatgggactaacctcccaacatcggataccgatatccgagggcttttctgtgcagaaccgaagttcatccgcacaccattcttcaatatcaaggagcaaacccttgctgacgaagaagatgggaagatttatgaactgacaaacttcatgaagcttttcgtggagatgaaccccaacatcatcgagcttatgttcgtagatgagaaggatattctgcaaagctctgatgcgtatgactatctacgtacaatggcaccagaactgctatcgagcaaggtggcctttagcttctcaggctatgcaatggcacagcttaagcgtattcgtggtcacgataagtggatcagcaatccacaacctgaagcaaagccaacccagaaggagtttttccgcttggtgcataactacagcgagcacccgttactgaaacatgaggatttcatgcaggcactggacggcctgaacagcttctgcatcctcgtaccttacggtaacaacgtttacggtgtgatggagaactttaatagttctggcctattcaatgctgacggatcgattcgtaatgtcgattaccagcaactgaccgatgcggataaaaagcgtaagcctttgtttatcgtaaaatatctggcagaagagcacaagctggcgaaagagaagcaccggaactactggacgtggaaggaaaatcgcaatgaggctcgtcatgaactcgaagtccagttcggatacgataccaaacatgcgatgcacctcgtgcgcctgatgcgtatggcggaagagattcttactgacggtaaagttctggttaagcggcctgacgctcaggaactgcttgatatccgtggtggcaagtggacccttgaagagcttcttgcttgggctgacgagaaagatcgttatatccgagaagacctgtacaaaaagacagatctcccaaaaacaaccgatcttgaactcgccgctcgtgtacttatgaccgctcaagatatctgctgggccaagatcgatgcttgaagcagtaatcggtatacttggggttgcatatgctgttattgctgtggtatactccataaagatggagaacgataaggttctccgtcagatttacaaggccaagacagaccatgattggtctgagatttgcttcgcggtcgggttcgcctggccgcttggggcattggtccattatgttatgaggagaagaaatgagacagcttgaatttatgggaagaatggtcgagttggttgcggaatggcaaagtgaatacaaaatgcaccgtaacatctctgatgaaccagaaaactggcccgatattcgagaccaggaggactggcttggtgatttttttgtgtggttacagtgtaaggggtacacattatgagttatggtttgttgacgccagagcaggcggagatcttacgtaagcgtttcctcttgcaagaagcaacaggcaacgacctcaaggatattgcaaagaatgttggtgttggttgtatgcacgatgcctgcccgaattgcggtgggacaggtattcgtaaagatggcctgggtatgtgtgttcacggcatctcctgcccctgcccgaagtgttctttcacatgttgataggcggtaattgcaatcacttaggattttgaacctttgtgtgattgatccttcctcctatataaaatttgccacaaccatgataaaatggaggttaatattatgataggaggtagtatgtttcagaaattggttcgtgaacaccctaccctacaagaacactggcaaactctgctggaaaagagttttaatcatcagggatgttaaaaatagcatcctttacaccattcgtgtagggcgattggaggtaactcgtggtgttgacactcaaaacccaatgacatacacgttccgtgttggagatatgggtaagctcgatcctgatgacttggaagaggctttcgaccagtacgagggttttgagacggcgatccgggacatgtatagaacaatcgacatcatcatcaatgagcacaagaagtctctgggatggggatacagaatcaaagactggttcaggaaccctccaaacaaggttttctttgccgttttcattatctacgcaataattagcgtggttgtgtatttttatccattattttgaggagattgcatgagggacagaggagattattacaaacagtatgccgcccggaggcgtgagatagaccgtcagcgtcgatccacaccagaaggaaaagcaagacaattgcaaatccgccttgacagaattgaggcggagaaacgtgcaacactcaatagtgagtgggacatcttcgttcgtgaagaggccaaccttctttgcaacgagaggatgcgtgacacaggcattccttgggagtctgaccacatgctgcccctccgtgcaaagattgtatctggcctaaactgtggtgataatatccaagttatccccgcaaaattgaaccgtagtaagaagaacaacatgatctacaccaaccgactggagtggattaaggatttggagaccctatgcaggacgaattaataaagctttttgtaaaggatacaaatcacagcgtgatcagtaaactgccgggaatatccggagcagtggcaaaagtcaaatccggatcagaatggtcaatcgttttcgttgtgaaggctaaacacaatgcctattctgatggagtgctttatccaaagcttacaataaagaagagcgcaggaaaaaacgagcaaatctttttgataacaacgaacaaggatgagaaaatctggatttatcctgatcgtgtgtgcatcggtgagggcgaggtatacaaccgagatatgtttttagactcatcatccccaacagatgaagaagcccaaatgctaagaatgagcaagggtgcggatcttgatatccttatgaagaaattcggaagagtacccggaaggatcttggaaagggtgatgtctggaatgtttgttgaggagtatgtctctgaaagcaaagaaagagtgattgttttaataagttaacccgccattggcgggttttcttttatcagtcctttgtcatcctttcaatgaccagactgtccgaatcatcaagaactgtcaggtgctcaataggaatgtccatcgttgttggcatcccccggacatgacattcgaaccaaatatcgtccaccgggtaaggtattcggtttggaccaatcttggatcgttcaagaacataacacaccctgccgtttagctggaatgtgagcgggttcttggggctgaatccgtataaaaggcagattgtatccgggcgcacacgttggtctggctcattacggtccgggcgaccgcccttatcttctaacatcagcatggtgtctccttattgggttgtttaagacatcatatttgataattgtgcgttagtcaatggttgacaaaatatttatttctgccataatggggaataaattcggataggagattgatatgtgtgaaaagtatggtgatgcaagggaagaacttgggagaatgatcgaaaggaaggagattcttgaagaaatcctgagtgatatcgacctgtgtatgcaaatcaggaatggtgctgagaaaggctcccaggaaagggcaaactgctcgcttcttatcgacgcattaatacacactgcacagaagatccagaaaagaggtcttcaatgacgtacagtatctacggcagaatgtctatggacccatgctcccgcgagggagagtggtactgcctgaaaagtaaagtaccgtttgacaagacggtagaagtaatgcaacattacagaaaaacttggcgatatgttcagaggagacttgaatgtttggatggtggaaaaggcgcaagcttaaactgatcggaacatccacttggacggtcaactggaccgacactggagaaagagatcgtggacaatggttgttctatgagtctgagagtggtcgcaggtacttcgaaagtacgcatgtaccgtggttactgagtaaagaaaaccgacttcccggttacgccgggtgcaaggcgtgggccagtggtgggcgacttcccgatactttcacaccagtgaaggtgattgaatgatctaccgaatcgtaaatattgtgatccatgcacttgcgttttgcgtagtgatgttcggggtatatgttgggctggacatgaagatttatccggtcatgtacgcatgtgctgcgtgtgcgttggttgcaggctggtttttgacgaagcatatcatgggagatgaaagattctcagaaatgcttttccgtttttcacacctcatctggaggacataatgcaaagcatacgctacgaggagcttctacgagagatccgcaaagattcaattgatcagtggttccattctgaagaggaataccaacaacacaaggagaaagagatgggcggcgatacaattcttgatttcatcaagcgggaagtgtggcaggatagcgatacagggaagtggcgcttcaagaacaaggagttcaaacgagaggggcaagcagaaaaggccgctgtgcaatatttcaagaagaaaaactcttgattttatggtaaaatagagttttacacaaggagaagacaatatgtttgaaatgctcttgggcggtaaagcccccatctccgccggaagcatcagaaaggcaatggctgggggtgcagacctgcttgccttgtctgaaagcggaaaactttacggtatctgtagcacctacctaagcggtacgggtgtagcaactacaaactggacacagatcttagatgatgttgaggatttttggtcaggattcaggcaatgccttgcaaaaatgaaagatgggagatggttattttgggggccaaactccgtgggagcgatccttattgtacgggctggaatgcagccgtagagtttatcctgagacaggacaacaacaaagattccccccacacaaattggtaatgcgggcggtatatgctgttgttgccatcattctgcttctcactctgaaaccgacctttacctgaagtgacccaccacacaaggggagcctgaagtggctcctctattcctgcctgaagagtcccatcaattttgtctaaagaggcacatcaatttcctcttgacgtaaactgtcagccctgctactattacctaaagagtcacaggtgctgaaggtctgcacgaaacaaacaccaagggtgccttgcacctgagaattgaataattctcattcaacaatctttacggacgttggatgtcctgattgttgaactgtaccaccgctcctgcgtgaaaggttgtacatttcattaacacacaatgcccgttgcacgggtgaactcgttcattgctctgcaacacaacatgtttaaggaattgcatttcttcgacacatgtagcctgaagtgtcgatgctgtaaacatatcgcagggcgattagccacaggctaacccgtatacgggtaaacatatcaaaacccacccctcccccgcccggagggaaataaaagaggccctgtcttgtatctcttggggacgaaaaatatccgttggctctatgtctgatgtgctagacggacaatcacagcccccgaaggttgtcaaggatctttacaaaatatctgagtggtccgatgtcgagacccttgcgagtttttggcacgatgattgcatgatgattacttgtgtgactaatgattgcctaatgaaactatgatgatttgattgattagccagcttacagcacgatttgcccttgacttgcttacttttgtgtgggttggtctatttaacataatacacgttatacgcaccacagatcggactgttgcatgggtgatagttgcactatgttaccattgcatcaatgaaccattactatgacgatgattagcctgctatatgttaccactgtgacagtttacacctgttattattcattttgtggggtgttttgtagatgataatgcttttcataatcattataatttcgattttcatttcaatttctaaatgaaaatcattccgcaaataaaaatattttgtaaatttcgcataaaacacttgacagggagggaaaattgtttttagcaatactctgcttttgagcattttgccacatgataacaattctcgtttagccctgtgatggaccggatacccggcaatgctaaagcattgaaatagttacttattgtaactattttctgtattactgctacacaagggattaatagacttttcctatcaagaaaaagcttgacacttgaggcatcttttatgctcaaaaacaagcctttcagcaggccagcggcctgatttacagatcgattaatcatggtttgtcaaccattaacggcgatttattgctaataaaaagatctaggccgctcggcggtcaatgtgtaacattgatcactttgtgaccggatcaattgactttcatcacctcgcgacactataacacaaagcccttacgggttgttttcgccacggaaaacaatgtccagattgaccaaaggggttttgtgaatcccctttatctggacactataacacgagagcgatcaacgttagttgatcggtgttatcgtggcgagtgtgataatttcattgtgtaactattcattgtaaatgaataataatgtaaatgattagccgttgcttaatcacgtatgtgattatatcgtagcgtctacgagccacgataacgcgaacgaaaatgataagtattatcatttgagttactctcgtgttatagtgtcgctcgctacgctcgcgccactcaccacgatcacgcgaacgattattttatttgacaagattttatttttatgctcaaaaaagacagttcacacaatggcttagatgagaaaagttatcaaatgagagttattatcacgtattcacatgaaacgcttaaaaatgcgtgttttattcagttgataacatgcgttatcaattttggggtgttagtgggtcaaaggcgataagcaatacccttttaaacgcaatataacgagttttgagcgtgttttctcgttagccttgccgttatattcctttcctgggatctctttaaattcacttttttgcataattgccaacggggttggtgagaataattctcagttgcgatattgcaaccaacataaaagcgggtaaagatttggtgttgtgtttggggtgtttgtgtgatatgcaaaagccgggacaattcccggccttacttacaacatgatagccagtgatccggcaatgatgaacggtagatcataacggtcgaaccgtttaaatctgtgatatttcaccacacaataaaacgccaattgcaagccgtcgatcatggtgttaactgtctgggccgttgcgtcactgagtacaaggcaggcaatccagccataaaaaacacttgacaaaacagccataaagcaagccctggttttgtaaagattttggccttatcggtaacggtgcattgattgactgtaaaccgatccgccgtcgaaactttccgccttcctcaatgcgtccaccatttcgcacattttgcgaagcacataagcacaatgatcgttaaagtcaagcgcttttctaatcatctcttcttttgtctccccgaagataaagaccaggtgatcaagggtgttgtagtgattgatccacgctctcacctgctcacattccagggggcgatccgtctcgctaaaacttgacaggccgaaagattcaaacgtggttacattgtccatcaattcactgtaggcggtgtcccagccactagcccagaactctacaggatcggattgaaaatcaggatcgtccggatgaataaagcagatagaaaacagttgcagattttcacgctttgtaagggtgtatcgtgcgctatccaggccgcgccctttcatatcttccggggttatttcatatttcatgatcatttgtcctggttgtgtggttatgcgccgtaaagcccatcactattaaaatcatcgtcaaaatcggccaggtattcgaaaaattcaaattccatagctacaacatgcttgacaagctcactatttttatactcttcaggagacaggcggatcggcgcgtcactatacagatccgttagttcgatatactccccgaccttttgagcggtaacggtgtttttcttgttgtcaaaaataacttttttcatgatatgcgctcgacaataatgatcgcttgcgggatagaatccggggtaactatcagggcttttgattggcggatcttaaagcctaatttcgctttgcaaacggtggcggtcattttccgcatttccggatcgacgttttgatccttacaataccacacagatttttcacctgcaataaggttgcgtaaaaattcagtttgaccagttgcatttttaatcattttaatttacctttcagattatgccggggatgtccccggccttgttttgtttagtattcgttagcatacattgctaaacggtcatcaaaggcgctttgagcatcagcacgatcccagaataagtcttgatcttgctgctcttcaatgtctaactgattatacaccgcttgcgcttgatattccatagccaaagataaacggctatcaacttcattaataacgctttgagataaacaaaattgcatactatcctttaacatttcgagcatgtacgccgccgcgctttcgtcctggtcgtggcaatatgcagaccagatagcgggcttaacatttttcaaatgtgcataaagatttttaacgataaacggcgaaacatcgtttaagataccgatcaaagattgcagtttgtcattattgctgatagtgatgaaattttgcatttttgtttacctttccggcttgccggggaaccattccccggcctcaaaaagatattaaccgatccgcgcctggcttgcaagcttttttttattcatcctcgccgtaatcatcgccaacgttgaaaatgtccagcatatcaccagcggcgatccatagcaggtacatttccagggtgtggcgatccatattgtcgatcccgtctaccccttcacgctcgatccctgtttcggccaggtaatcgcggatcatttggtcgctgtatgcgctaaactgtaagccgtcccggaaataaggcagggcctccaccgttgacgcttcacagtccccagagtgggcgatctcttctacctgctcacggtcccgaaagatgagacaaaggcgaccgcatgaggatgaccaataaacatttttatttttcataaatctttaccttcccattatgaccgggggcgatccccggcctttaagaatactttagccgatctggttttcagagtcaaccggaaaaacatcattcacaatcgcaacaaccacggcgaacacgtccacagattgacggatcggcaagctgtcagcctgctttacgtagcctttcgcgccttcaagctgataagacacgtaatgatcttttactgcctgctgtgatgcgtgatcaatggttgtttccgtgcggatcataatgtccaggcgatccccgttcacagcgtcattaacatggcaaaaacgcattaaggttttatcatcgaaacgacgaaaatcacattttgcattatcggaaacgccagccaggaaaaagaatttatttgcaagttccatttttaaaacctcgttttagatgaaagataataacagcaggaagatcacgaaagaccacaccaggcgacacataaaacgcgcctcaatgtaaaccgggttttctgtagtgtattctactttgtaacctttcatgattcacctctaccaggtgaccgggaaccgctcccggccttgtctggtaattattgatcaacggatcgccgttgtcaaatgtttttatggcattggttccacttctggcgaaggaatacaggccggattgatataatcaggatcacggcgtaaaccactagcggcgatctcgcaagatagcggatcatcgtatgattcaataacaaaatcatcacattgcatcatcatagatgcgccataaaaacagatacccgcgaaaacttcaaacatttgattaaccttattttttcaggtaaagaatttgggttttgtcgccttttttagcgccatctttcaactcatcacaaaggccgaattgctcgcctttcagaagattatagctgttttcgtacacgttgcaagccttttcttctgtaaaagtttcctttacaatccaattacactctaatttcatggtcgtaagggaaatgtgacaagccattacaataaatccgaacatgatcaattatcctctaaaatgatatagatagcaacaacggcaagcattgcgaccaaaaaagatacctgcgccaccacacaccaagaattagtataatctaacattttgtttaccctcgtttgtggtggcaccgttgccgcctatgtagaatcatagcataagcggcgcgggtgtcaagcgttattttttgatctggtttgtgcggttgtaatcctcataacgtacacgggaaaccgtgaccgattgaggcaagaggcaacgaacacgatccgcccggttgtcatattttttgatatgctcaggggtattgtggcgggtaaacttaacacgcaaacgtaatttaagcggatcacggtcatcaatgccagtaaccacaccgaaaccgatttgcccgtaattgtggtaaaccattttacccaggaattgagattcaagcgccgcgatctgagattttacgttttgcattttatttacctttggtttgtgtggttggcaccattgccgccctacgcattaaagataacataaccacagcaggacgcaagcactattttaaattatttttgttgagaattgttctcatatgcagcgattttgcatgaatagcgacaattatgcagatagtttcactgcgttactaaatttaagggcctttgagcgtggcggggttatgtcataccctgcaaaacgctctaaaacgctttctaagcgcttccaggcttgaccctggcaagtgcatcacctcgcggagatctccttaaattcacttttctgcatagaaaaagccgggaattatcccggcctttcgtttaatcatcttgtacggcttgccactgtaaagcgcgctttctttcggctaaccgcttgttaagatttggatcgtagcggtccggcgtccaggttttggcgatgcgctccggcttgtgtagtttgtcgtttcgctggcgtcgctcgtttacttccccatatgccaggcgatcacgcttgcttgtcatcttttcaatgttgcgcatattttaaaccctcgttttattttcggttgttgtttgcatgttcaaagatccggccttgtttctcggctaattcattagctcgccattcgatgatctccgcgatctgctcctttgtgccttctttgtgatacgtgactactccgccccgctttttcacttcacacaataagccgttaccctcaagatcatttaacggaccagatcgccgggtgtggtagtggttcccgtggaatctgtattctaaataatggtacactttgccgatcctgtattcataataaacccacagcaggccccgccataacctggcggggatcttccagtagatagcagcagcagccaccaaaaacaggattttaaacacttttaataatcctctaacatctcgcggagtgtctccaggtcttcacctgtaaacactttgcggagttcctcgcccgtcttctgacaagcaagataaatctctaaacctttgcggctatcctcatcatagcccatattagcgcaaaaatcagcatgagattcagatcccagatcaatatctgacagcaggcaggaaagcacgtttgcggcgcaaggtgtcgcaacataaacacggtaaccgaaagacattgctttattgtcgttgcgcttgtaatcgtcgcgtgtccagttattttgatcaacgatggaaaccttagcatcaactttagctaattctcttgcgtcggttggggttaagccagtgtgacggcctacacggtgacccgttcccgttttaaattcagagcggtaaatcttcccgcctttttcgaaactcacgaaaaacaaatcagcttgccattctggatcgttgttaacgccaccatataccgctttaaaatcaatccctttttctttcaggaagttgaaaacggcaacatcttgatcgttgaaagtgattttgttattcatgataatttaccttttgtttggtttggcattattgccgggttatttctcttacttggtagggcttatcttaaagccccacctattaagagtcaacaattatttaatgatttctttcccgaaagaatcgaaagcggcgatcactttcaagctatcatctaacagcttaccggggatctttagattgtcgatccgttggcttgcctcttgctttacgtcctcaattgtgcggtttgcagaattaaagatcgttaaaacttgcccgttatccatgcttacgaccatttcacaccgcctttaaataattgttagttacccggtacacatggcgataagcgcgctttttagtgtggggcgcttcggtcattgattcataagccagatcataaccgattttttcaagccagtaaagcgctgcgctttgcccttcgttgtgtgattgttcccggcgacggggcgactccaggaccagcacaccgaaaccagtgtaaccattttggacggataccagatccccacggtgaagcgtggcgcggtatttgttgatcgtgtttccgttaacatcgcgaccaaaatcaaaggaatcaacaacaacgaaaaaatccccggtttggttcgtgcgtgacaatgaggccaggcggtttacagcgtcatacagattgatagatgttttaaactttgccattttctttaccttttcagtctggcgggaacctctcccgccttgattaataatgtaaccgatccgccgatggtttgcaagctatgcgatgaagttttttaaatcttttttgcgcttgtctgtttcttgggtgacgttgatttttaagccgttctcactagcccagcgatccaggtggccccattctgattttatcccggtcatagtggaaagatctttcattgcaacttgtaaagcgtgggaaccgtaaccataacgcagatcccgcgacttgtacagcgtcggccaggtgtcgatctccggggtagtgaacgaaagctcataaacaaaatatgtattaccgtacatatctgtaaagtcaagagaatgaaaatttaaaattgcggttttgttttctactgcttttttgaaaatctcgatcatgttttccatttcgtttacctgctttcttttggtctgggtattatgcgccagtctcccggcgcttgtcaaattattttttatcgggccatatgcgccgctaaacgtgcggcgatctgggatcgaaaatgagctat

SEQ ID NO: 2 - DNA, 143876 bp, Artificial Sequence
  Bacteriophage San14
ggcattcctgagcacatcatcgcgggttatcgtaacctgggtgactttgatgactggtctgatgcacatactgcattgcaggaagattcaaattcagaagttgccaagattgaaggtaaatactaccgcattcttgttgacgatgaagataacgccttcttcgatttccagccttcaggtcttgaagagcacgaggtaaaaggtgcggtcgagtgcctgtgggatatctttggtggtgaagtcaactctaaaggttacaaggtccttgatagtcatgtcggcctgatctacggtgactctatcactgttgctcgtgcaaaagatatctttgaacgactgaaagatcgtggctttgcatcgagtaacatcgtgtacggtgttggttcttacacaacccagtacacaactcgtgattcactgggtatggctgtgaaagcaacgggtgcagttatcgacggcaagcagatcatggttgtcaaagagccgaagactgacctcggtaagaaatctgcaaaaggtttcctgaaggttattcgtgatgaagacaatcagttaaaactggttgacaatctggaggtgcatgaggtacagtctcgtgataacgaactccgttgtgtcttccgagacggtcagttgatgattgacgaagacctgacacagattcgtgatcgggcagcttctcagctttaaattatcagccccttcgggggcttttctgataggtaggctatggaaaatccatgcaagtggcatgaagtcccagtacgagattgccttacgtgtaataacacaccaacaaacccgtattatattaaggagcctaagatgtttggaccagtaatgatggagtgcaaagtctgtaaacaggaatttgaagctgatcttgaggcccacggcccaggcgtttgcatcatttcctttggctgcggtcatcagatgaacgccagcaaggataaaacagtgtgggtaaacactaaaacaggaaaaattgatttggaagaggaatcctgtgcgtagtttaacgcaagagtatctcaaaacccgtttgcattacgatccgcagacaggcattttcacatggttaaaagagggtttttcaagaaaggaagacgctacccgccttggtggaacagagtgttcttgcgttggaaagcacggttatgttgtaatacgtattgatggaaaactatacttggctcatagacttgcatatctctatatgactggagaaatgcctgaatttgttgaccatgatgacaggataaggaccaacaatgcgtgggtaaacctgaagaaagcaacacgcgaaatgaataataggaatgtcactgcatcttcaaacactggacatgttaacataacgtgggttgaaaaacgaaagcattatgttgtgacaataaaatggggaactgaaaaacgaaataaaacattcaggaaccttgatgatgcaatattttggcgagatagagaaaaggagatattgagtgcgaaatccagttagtcgtcatgatttcaatcgtgcatctgtacacacagaccagaagaaggcgtgggagccggacatccttgatggtctggaggaacatttccttgagattgataatccgaaggaagatgaggaagagcttgaccccaagacgttagcactagcagaatatcgtcgtggtgtcaaggcatcagggattgtttgattgacaaaaatagtgaccactgataagatctaagctatcgaatcaactcgaaattcttaacaacttaacggtaggtcattatgtttaaattaaagcttgtacataaatcagataatggagagtacattgagcacgaatcacaccacccaacccttgacgaagcgactgaagaagctaatgacatcgctttttctacgactggctttggcattgaggcatggcaatacgttgcatccttcggagaagaaggcggcttatactatttctaccccgttgacggtgattccacaatcaagtacgctctccgaatcttccggacagtataaaaaccgcaagcagcgccgtgctgaagcggcgattacacgttcaaagcgaaaaggagtaaaaagatgaaagacgaatttgacggatttattggttacggtgaaggcattcgccaggctgaagacgtagatattttcgtaggtttcggagagggtatttcttctgatgaaagaccagacctttgactcaatctttgaattgagcgacagagactggcccactgatacattccgtaatttttattaccacactgaatgtgatgtgtgcggccttccgttcatgggtccaaagaaggtaaccacctgcaatgtttgtaaacagaatgtttctgtttcggacatttcctgaagtaaattgggaccttttgcagtaaaatagatcatgcagatactactgctgcacataacccaggagaaataaaatgtttaaaaaggctattcttggcgcggttctggtagggacactggcagtaactggttgcaccagccacaaaactgagcgtcttgaaaaactgtcaggcgatgttgcaactctcaaccagaaagttgatcaactgcaatctgacgttgatgtgatgaagcaggatgttctgattgttcgcggtgacgctgcacgagctaaccagcgtcttgacaaccaggcgacttcatatcgcaagtaataccagaagcaccggaaataaaaatccggtgctttttttcattttaggtgttgacaatggtttctttaaccattagtattcatctcaccaagacggaatggttctgtagcttagttggttagagcgcttccctcataaggaagaggtcgcaggttcaattcctgccagaactaccaaacaggagatgcaatgaaacgtgtatatgagttttttggtatcattgaaaaaccaagtatgtcagaatcatggaaaagccgatttgattctatcaaggcaacctcggttcatacatatgatcgttatgacctttcactcggtcttcataaagaagtgaaaaaagatttaaaaaacgattgacaaaggaagtgagagagtttagtattaccaacgtcaacgagacattagcaaatagaggagaaataaaacatggctaagaaaaacgcaaacaagaaagtttctgcaatcgacgcaatcaaacagccgttccagtttgagtccaagtctacgcagacccactctgcccctcatgatgttcgtctgggcggtgtaacaaagacggtttctattcgtaagaagcgtcgtgatgaagatggcaacgttgtatctatctgggaatcagtttcccgcgttgaaggtggtcaggtcatttctgcctcacatcgtgttcgcactggcaagaccaagcgtgaacgcgctggtaaagctaaagacgctaaggttgttgaagccgtagcgccgaaaggtaagaagaagtaattcctccggcatggggatagacgaagctggctgcggcgatgcgtcttaaaataaagggccgtggcaaccgtgacgatcccgtgcaacgtcttgaaaaacacgggccagattcggggtattaacacagcggttagtgtagcggcctcttaagccgaagaagtgggttcgattcctactgggagcaccaaacaattcctcgttagctcaagttggtagagcagtcccaagattcgggataagcacaggttcgattccgtcacccggctccaaagcatattttgaagtgcattagctcaggttatttgaaccacggactgatcatctgtgcggagaatgagcctaacggaatggagtttcagtgacaaaggccacgttgctgtaacagaagtttcagggtcgtagagcgcctttcgcggagaaaggaggtcggtggagtcaccatgcaactcaaaatatgtttgcgtccttggtccaacttggtagaggcatatgtatctcgataagattagaaaagttttaggtctgtatgttagggatgatggcaggcaacatgtgatcatctatctttatgacggtatgcaaatgacaagaagctacccaaagtatcttatggagatgcatcttggaagagagcttgatccagatttagaaacagttgaccacatagacagggatgtgaataacaacaacatctctaatctgcaagtcttaacaagaaaggctaacgcagaaaagagcgctctaagagcaaaggaaatatattgcaactgtctttggtgtggtaatacctttaaattgtcaaaatcacaaaggaagaacagatctgataaaaaatctggtcctttttgttcgaggtcttgctcagggaaatatggtaagcatatacaaagcggtggacctgctcttggaaaagattttgatgtatcttatttcaggaacgatgattgcaggtgtggtggaaatggagatacacaggagacttaaaatctcccgcttaaatgattacgagttcgagtctcgtcacctgcaccagaattaacggggtgtagtctaagggataggcagcggtcttctaaaccgctcaatgctggttcgaatccagccacctcgaccaaattcatatgactgtccgggaagcgatcacgccgagacagaggaagcgccttgatcggctatgtgtcacatcttgacccgaatgtgagtgaggaattgaaataatcgggtccacgcaagcacggttgctggagtggcaacagcttcggctgcaaaccgaatgtcaggagttcgattcttctaccgtgctccaacactttaaatttaaagtgaattatgttaaaataacccttgacagagaaatacatctctgataatatgaatgagtggggttaattatggcagcaaaacaacagcttacaaagcgtcgtcgtggaaaagggcgtcctttaaaagaggagtcaaacgcaatccagcttgagaagaatcttcttgacctgaagacaaagatgatcgccatgattcctgacgcacaccaggttttacgtgacctgatgatgaattccagcaccaaggacaacatcagagagaacattgcacgtttcgtcatcgaaaaaggcgaagaaatgatgtctgattacttcgatgaagaaaatgaaagtgaagaagaaactaaaaacgttgatgacggtaataaggttccggagaaggctccatcaaaacctttcactaccgacatcgttcctttcaaacaaaatggttaaccaaaatatcttaatatgaggatactaatatgttgaattggggtttgatgtttcttgttatcgcattaatcgcggcagttctgggatttggtgcattggcaggaacagcagcttgggctgcaaaagttgtatttatcgtagcgattgtggtttggatcatcagcttctttgctgatcgtcgtccaccgctataaagattttggctcattggcagaacggtgattgcagcggattgtaaatccgtgcccttcggggttcctggttcgaatccagggtgggccaccaaaacaaagggagtatagctcagttagtagagcgctcgaccgataatcgagaggtcgcaggagcaaagcctgctactcccaccaaaattatgcgtcattagtgttagcggtccagcatcccgtccttccaagtcggtggcatcggttcgaatccgatatgacgcttaaatatgtcctgttagacaaactggtaaagtcaccaccctttcaaggtggggtttgcgggttcgatccccgcacaggacgccaaacattgtgcgggtaacataattgcagtggctgcaagctggcctccaaaaccagtcgtaaggggttcgattcctcaccttcacgccaatagggggttagcatagctggcctaatgcatcgggctttgaactcgacatcggaggttcgaatcctccaccccctgccaaatttgaacattttcttttgagagtgctcatgtgtggcctaagcatttatgagatgatgttcaacctgtgacgttgaggaagtgggcgcgatacccacaggtcaccccaatttggtggaatggtcgagcggtttaagacagcatcttggaaaggtgtcggccccttaacaggggtccgtaggttcaaatcctacttccaccgccactttaggagatattatgcagaagcttttacgttgtaagaaggtgtttggtcgttgcaagatccacggaagtaactgtggtgttgcagatgagattcaaagcatacctattactcgtgcaaaagaaaaagcggatctccgtaaagagattaaagaacaactcgatttggagagatcatgaaaaatgatgaaaatatggtagtgattggtattgacattgtggatgataaaatagtaaagtatcactacgccaatattgaagtcgatgggcatggtagtgcaaagttagtaagagtggaagattaaccctaatcaggtaagggatctctttgctaaagagacagtagccccgaaaggggtgtgtcagttcaagtctgacatcttcctccggagagcaggacgcatggtgcgtaatccggtttgaacccggacccatcgtagcgatacggtgacagttcgattctgttgctctcctccaaatatgggttggtagccaagcggtgacgtatgtcgaaggcactcgacttttaatcgagagatcgttgggttcgaatcccacccgacccaccatattaatttagttaaaataactcttgcaaaagattgttttagctgataaagtagttaaatgacgagttggcctagtggttgggcgacggcctgttaagccgtgagtgaaaactcaaggaaggttcaaatccttcactcgtcgccaaatttatggggccgtggctgacaaggtaatggtgccgcactgtctatgcggaaaatgagggttcgatccccttcggcctcgccaaacatcctccttgcaaattaaaactttgcttggagaacttattacctagccagcgataccagttgtaagactctgggacaattaaaacttacacaatctgttcgtagcgcagtctggtcagcgtgggtcccttggaaggatcaggtcggtggttcgagtccacccggccccaccaaacaattgcgtggtagtgaaacggatatatagatcatgttggcctcataagccgaagattgcgggttcgactcccgctcacgcatccaaataactaagtggacactaaggaaggtctcggctgtggaaacggtaagacaccctcgacgagtaaaggttccttcgccacttttcttattctaataataataaatattcaatctcctctcctttgcctcgccccgctattgcggggcttttctttttctggtacactccaatggtttaattactaaaggagaaaaccatgcttcatatctttccaaaagaagaataccaacgtgaatacctgatcctccgtagccttattccaaacgggttgatggagatccttaaacgcctcgatgtccgtgttgcgggtggtacactcacatccttattctccaaccgagaagtaaacgacatagacctttacttcccttcatgggagaacctggaagttttccttgcgtacatgactgatcgtagcctcttgaaaggtcaatcagacctgacagaggcgactaataattggggcaattccaaacggtcattcaaatatttcagggaacttgacgatccgggaagctttaaagattatgtcaataccctggtgatcaaatctgaagataaaccgatgacacgcctgtcagttgttgccttggcaaaaatctggaaagatatgtctgatgaggattttaaggcattcacccaagcggttaaagagagtaagattgacaacattgacaatatcggtatgaccgataaaagtgtcatgtttaccaataaaaaagctcccggttctgcaatgtatcgcttttgatgttttccctgatgcacagaagatatttgataagtttgactttacgattaatatggggtcattcagctttgcaaaagagcagtgggagtttgacaaaaatttcatgaagcacatcgctcagaaggttttggtattgaatcccaagacagattacccgattattagtatgcttcgtgctgataagtaccgcgctcgcggttatacaatctctcgccgggagaccatgaagcttggcattgcagcttctagtttgagcattgaaacttgggaagatgccaaggcccacctgagtggtatgtatggtacgaacgttgaagagcttttcgatgaagaaaggccattttcatttgagctattatttgataaactggatagtgctggtgataaaatcatcagcgctattgcaactgactctgagaagggtggtaaaggtggttggacaggtcttaaagaggtaaatatctttaccatgtaccaacgcctccgaaagaatactggaaggccatattttaaaactctgtggggagtttgtccttctgacaacttctacctgatgcaagctgtagagcaaaggcacaaagttggtcttctggaggagaaaccagcacaagatttccttgatgtgatgaacctttatgtagacgagcaggaagccttgaacgtatacaagagttggggtgagaaaggcagaactggtagatggggagaaaaaacctctttacctggcgctgtccttcttgaggtgtctgtgagcgaccctaccaagattgcctacaatgatgctgcaatagagatcgaagatgaagatacaactctgctcaaaatcgagcgggtaattgataccaatggggaaatctcatgatacaaattgaaatggctttgaagtttctgaaaagcaatctaaaggtaatcgcagtggtcatcctgcttgctgtcctcgttggcgggggattgtatgcaaagcactggtataacgagcagatcacgcagtcctacaattcaggggtgagtgatacagatcgaaaatggaaggatgtgcaacagcaaaacaaggatgagaatcagtcttacaaggatgaacaacagatcgcaagcgatatccttgaaaggaaactggcagaagagcaggcaaaaaatgcagaattgcaggcacagcttaacgcaaagcaagacgcttacagcaggtctgatgcaggcaagaagcaagggcttgacaaccagtttgttgacatctacaacgaaagcttgggggtgaaatgaataaagcattaatggcagtgctgatggcagtcaccctactggtcggttgtcaggcgaagccggaggttgttccggtagttgagaagtttgatcctgcaaaggttcttgcacaaccacctgctgctgcaatggttgatcctgtggagccaactcccctgaagtatggtgcttcaaactcagagaacagcgcgatcatgaagaccaacaacctgaatgctgccaacgaccgcagcaagttaaggactctgcaacaatacgtccgtaacatttttaatccgcaaaagtgattgacaaggcccttatttcgtgataagggctttatttttatcaagtttcgtggtaaactacctcctataggccaaattacgcctttaatatggaggtcttttgagtaaaacattcggacctgccagccctaagcagaaaatgatcctggaaaacaacgcacaaatcctgatcattgggggtgcggcggggtcaggtaaatcctacctgcttcaattaatgccgttaaatatcatcgacgatccacgaacgaactgcatcatgttccgtagaaacacccctcagttgaagggtggtggtggtctgtatgatacagcacgaggcatttatacacagcttgatccggaatggaaaccacgcttcagggagaaagacctggaagcaattttcccttctggtgctaaagtaaaatggtcccacatggaatacgagaaagataagtattctcaccagggtctacagtacacctttgttggttttgacgaaggaacacagtttgaatggtctcagatcgaatacctcatgtctcgtcttcgttctgaatccaaatacccaagccgtatggtcatctcatgtaacccggacccagaccacaagattaaagagttgattgagtggtatctcgacgatgatggtttccctattgcggagcgagacgggattatccgttggttcattcgtcgtgacggtgagttcatctggggagatacagcagaggaacttattgagcagtattgggacggtgtggacattcgtaagaagccaaaaccactttccttctcattcatcagtgcgactatcttcgataacccaccgatgcttgacaacaacccagattatcttgctttccttgagggtcttccggaaattgaaaaggcacagctactccacggaaactggaaagttcgtccagaaggtgcgaactatttccagcgatcctatctcaaggaagttccttgcctaccactgggcgttacgtccgttagaccatacgacaaggcaggtacagaacgaacatctggtaacagataccctgactttactgcatctgtgaaggtaagtaaagactctgatgggttttattatctttcaggagattattgccctgagtttgttgatgatggtcaatactccactcaaacgcaaggccgtttctgtaagaaagctggtgaacgtgatgtgatcattaaaaagcaagcccattacgatggggatgatgttgttatcatcttcagcgttgaccccggtcaagcaggcattagtgagttcacaaccagcgctcgtgagcttctggctgaagggtttgtggttgagagagacccgacgccagggaataaatcaaaacttacacgcttcactccttttgcaaaacttgctcagtcaggaatggtgaggattgtcagaagcagtttcgatgctaagacatatgaagccttaatgactgaacttgaaaagtttaatggtgagcgaagcacaacaacccgtaaggatgactgggcggatgccgttgcctccggtattaattacttggagaagaacgagatcgtcagacctgttgttatcccgaaaattgttgctccgaccttgtacaagagaatataacagaggggataactcgtgtcaacaagatttgcacaaccatcggaggtggttaaagccggaaacgaaaatctggctgttagtcgtctccgtaccggggaactaggttctggtgctctttcacagcttcgtgcagaatccgaagttatgaaggtggaagagttacgctggccttgttttctggcaaccgtcgaggctatgaagcaggaccatactgtctccacggcgcttgatacgaagtatgttttcgtaacgaaagctttcaatgatttcaaagtcctgtataatcgtgacagtaaggcatccaaagatgcagccgagtttgtagaatacgcgttgaagaaccttgccaaccagcaaactcttcgcgatattgctcgtagtgccgcaacctttaatgagtatggattctccatctttgagaaggtgtaccgtactgaatctgccccatctaaatatgctgggtacatcaccattgataagattgcctttaggccacaatcaagtctttctcgctcaaaaccttgggtttttgatgaggatgggcgcaccctgaaagggatttaccagagtaagatggcctttgccaacttccagaacggtctgacgcaaatctccagtgctatgagcctggttactaatctgacctcctctgcggatgaagtgttcattcctatcaataaactgatggtgatgagtcttggtggtacagagtcaaaccctgctggtgtttctcctcttgttgggtgttaccgtgctttccgtgaaaagattctgattgagaacctcgaaacaattggtgcttccaaagatcttggtggtatcatcgaactcaagatcccttctcagatcttgaacaaggcagcgattgacccgaaatcaccagaatcagaaatggttcaaggattgatggcggatgctgcaaacgcccacgcaggtgagcaagcctacttcatcctgccttcagatatgaacgctcagggtggtgaacagtacaagatgtctcttaaagggattgacggtgcaggtaagcagtacagtacacaggaactggtgaactctcgtaagaaggcaatcctcgacagatttggcgctggattcatcaaccttggtaacgatggtcaggggtcttacaacttatctgaatcgaagcagtccatccacggacatttcgttcagcgtgacatcgacatcattgttgaggctttcaacaagaacctgatccctcagcttctggcactgaatgacatccgtctttcagacgaagacatgccaaaactgaaaccaggccttatccaagaagtcgatatggaaggcttctccaagttcgttcagcgtatcggtgctgttgggtatcttcctaaaactcctacagttatcaacaagattcttgaagttggtggctttgacgaagagatcccggaagacatgtcaactgatgaacttctgaaactccttggtcaggataccagtcgctccggtgatggtatgacagcaggctctaacggtaatggaacaggaaaaatctcctccacaagagacaattccgtatccaatatggataattaatttcaacttactgaaatagcttgcaaaagaaaatgaacggtgttaaaataactatcaacggggaaaatgatgaaatacacaagtattgctgaccttcctgcatcggtatctgatctgtctctcgttcagaagagcaaggtactgagtattgcaaatggcctgattgcttcaggccaatctcctgaagccgctatcgagaaggcttccaaagacattctcaaaatgaatgttaagactgaaatcaacaagtcaacctctgttgtgagcatccagaaagacgctgatgagcagatgatttcttacgaagttatctacgaaccagatgccaaggacgctcacggcgaatggatgtctgctgagacaatcgctaaggccaaggagtcttttgataaggcaaacgaagctggcattgttaaagagaacctcttccacatgattgagactgactctttcacaatcgagaagacttggattcaggaagaatttgatgtggtggttatcgggaccgagcaagtaatcaaggctggcacctgggtagctaaagttaaatataacgaccctgtactgtgggaccttaaaaagtccaacgttgttggtggcctgagcattcagtgttccggatcaatcgacaaagcaacaggagaaatcaccaacgttgatttcggtgtcgagtatgttgaggaagatggcgaatgacaattgcaaaagccaagtccattaaggaaaaaggtatcgcactctgccatgagagtcaagggttttctgcaaacctccgtccagtatcacttctgatgaagtctgacctgaaaccggaacagattaccgaagacgttatcaaggcgctgcaacaggttaccgtttccatgagtttcgaagagttcctgcgtaagttcttctatatgtggagcgacgatgcagaactgcttgccaaactgctgggctttgaaactgaacttgaaaatgaggccgctgaaaaccctgatgatgagtgggtccaagcttggaacgcacagcaccaggaatggctggaagggcgtatggagtcaatctctatcgccaaggcagcgcacagcggtgaagaaatcgaccttgttaaacagtatgaacttctgaagcttcagcaactgtttgaaaagggagtaagcgaattaggtctgaccttctccgaaggtgagtccgaagatctccaggtgactggggtcgtcaaagaagcaggtactgaccctgtaattgatacatccaaagaaaataaggagacctcagtgtccgataatgttactgatgtaaccaagtctcaggaataccttgacctggttaagcaactggaagatgccaaagctaaagctgctgctgctgatgaaatcatcaaagccgctgttgaagtagaaaagaaagccgctctgactaaagcacaaggtttcacctttgctgctgaagctgaccacgcttctctggcagatttcatcatcgaaaaagctaacgctccggtagtagctcttctggaaaaagcccaagctcgtattagcgaactggaaacagaagttgaaaccgtgaagaaagagttcggcactgctgaacacggaaaagacggtgaagcaactgttgatgacatcaacaagtctgccgaagacatccttcaggctaacatcgagaaagcgaaagctcgcgctcgtgaagctgctgcactaaacgcctaatcgaggagatttaaataaatggctaatccaatccaagggtactactctgacatcgttctgggtaaagtggactcttctgaccagggctacagcttcctggaaatgccgattgagttcgtagctggtctgaaagcaggtatgattgtgaacgccgctggcgaaccaattgccgcttccgctgctgctgacgcattcggtgtaatcactgaccgtgatctggttcctgcttacgatgctcctcgtgacttcgtggttggtactacttacaacttcgttgtggcggttcgtggtctgaccctgaacaaattcaaactgtttttcgctgacggtactactgcaatcaacgctgccgctatcgctgctcttgaggccaaaggtctgaagatcaccgataaatattacgacggctctgttgagatcccagtaacgtctatctaatctacaccaaggagaataacaatggcagtagtacgctctaatgacttccagatcgtcgatcttggcgcaactctggaaatcgtaccacgtcagtaccgtcttatcaccaacatggacctgttcacagcgtaccacggtgtttcgactgtcgctcagattgaacgtgttgacgaagttgtaaccgacttcccggctcgtcgtcgtcagggtgaacgtaactacgttggtactgaaaaggcccaactgaaaaacttcaacatcccgttcttcccacttgatcgtcagatcactccggcagacgtacagaacttccgtaagtatttcactactgacgctccgaagactgtagaagatgttgttgctcgtgtggttcgtcgtatccgcatctctcatgaacaactgaaagaaaaagcaatgcttcaggcgatcatgggtaaatcttgggcaccacaagacccgactgctcagtacaactacttcaccgagtggggtgttactcagcacactgcaaacattgacttcaccaatgttgcaatcgacccgactgacgttctcgaagctgaagctcgtgcttacatcatcgacaatgcgggtgacaatggcaacaactacggtatcgtagttctggcttctcgtaagtggttctcagcgctgatcgctcatccgctggtaatgaacgcttatcaatactactcttctactcaagagccgcttcgtcgtcgtctgggtcagggagcagagaacgccaacaaccgtatgttcgttcacaagaacgtaacttacatcgaggatatctccaactacatccctgatggtgaagcttacattctgccgcaaggaatcgacgacatgttccagattcactatgcaccagcagatgacgttcgtgaagcgaacactcctgcacaggaactgtacctgtggtacaaatcttctgcatacctgcgtgaagaaaaagttgagtccgaaacttccttcctgactgttaacacccgtccggaactggttgttcgctctactggtactttcgcataagatagcgtaactgctacctctaagagggggaggtgattattcacctctccctttttctttttctgccttaataatagccacttcatcaacggtgtcaagtggtttttactaaggtaaccaaatggagattttatggctaatcaaaactatcgtattttccctaacaaggtggaattgttcaaattcttcggtacttacgcaccggatctgaatgttggtatttctgcccgtcttcctctgaacggcttttgtgtcggtactgaacaaagggctttccgcaactctgttgagttcttcaaggcgcttgccgagatctctggacttgatgtggatgcagaacactctaccctccgcatgggtacatacatcgtattcttcaacagtcctcttccaaacccgaatcgtcgcggtaaggcagtggaggcaattgtaggccctaaaggtgaagaagtcaagactgaagaggtgaaagtgaagtctgctggttacgaagcaattctggctgaagcagaagcactgaacgacgaagctgacaagaaagcgagcaaagataaacttgctgacctcgctgcaaccaaaggcattacccttgccaaaaacaagtctttcgaaaacatgatggctgacttcaaggctgcgcttgaagaattagagcctgtaaaataaggggtaaaaatggcagattacaatgataaggtcgtcaacgctgaacctatccttccggaaggtactggcggtggaacctttgtggacgatggacaattccacacagaagatacgaccacagtaacacttctcggtaatggtaactccactactccgctgaaggccgctgttgttgtagatcctgcttccggtaacgcccttgtagctggccctgacggactttctgtcggggttagccctctcagtgataacctgcttgtattggcaggtggaaagctgtatgttgctcctcctcagatcgttgtgcctatttcaaccaagaccggaaacgttcttgttgaagtgaccgaccctggtgaagaaggtctttttgtccctcccggagaaaaaggcgataagggcgacaagggtgatcaaggtgatccgggtgttggtatttacatccaaggaattattggagacccatcccaacttcctcctgctgcaaccatgcaagagggagatacttacgtaattggaactcactactggacagttgtgaaaggcacttgggctgatcttggcgatttcgctggacctcaagggcaagatggtataggattggtgatcaggggtgcattttctgacacatctctccttccgactcaaggaaatacggaaggcgatacctacatcatccaagaccagatgtgggtttggactggcgatgcagacggatggcaacctgtagggcaagtagggcctgctggtccacaaggggctactggtgccacaggaccgcaggggcctaaaggcgataaaggtgaccgtggagagaaaggtgaccaaggtattcaagggattcagggcttaacagggcctcaaggacctaaaggtgacaagggcgataaaggtaacgatgccgcaattgtaaaactgaagggaacaaaagcaacagttgacgaattgcctgaatttggtaatgctgtggctgatgcatgggttgttcaaacggacaatcacgtttgggtttggacatctgacgacacttgggaagatattggtccagttcaaggacctaaaggtgaccaaggtgatgtcggcccacaagggcctcaaggacaaaagggcgaccaaggcccagaaggtcctgcgggggcagagggtcctgctggagcagaaggtccacagggtattcaaggacctatcggtccaaagggagataagggcgatactggtttaactggccctgtcggtccacaaggacctcaaggtccgaagggtgatcgtggtgaaactggttatggtgctcgtgttcttgggacaaaaggcgctgtttcagatcttcctgcaacaggaacaccaggcgatgcttggattatagttccaaacctttacgtctggagtcaggctgatgctcaatggataaacgtaggtccatacgttggtccaaaaggcgacaagggtgacaccggggctacaggggatgtcggtcctaaaggtgatactggggctgatggcccacaggggcctaaaggcgatcagggtgatgaaggacctcaaggtcccgcaggtgctacaggaccacagggtccaatgggcgtttcactgactgccagaggtacagtagccaatcaagcagctttgccgtccggcgcagcaactggagatctttacaccacagaggacactggagaagcttttgctttcgatggtactaactgggtaaatcttggagtcatgcgtggcccacagggtgatcctggtatccaaggtgaccaaggaccgatgggtgcaagtatcgttgctaaaggtgttattgcgacttatgaggacctgcttgatgttcaaaacccagaacaaggctggatgtattcagtaacttccggtgggaacaaaggttattcttatgtttacagcgggaccgcatgggaaccgatgggtgacttgacaggtccagaaggccctcaaggaccacaaggaccagagggtcagatgggtgctggggtagaaatccttggcaaactcgacaataccactgaacttccttctactggagagcttggtcagggatacttgattgagggagatttctggggatggactggaaccacttatgagaacttgggacctatccaagggcctcaaggtgatgttggaccacaaggtccacagggtccacaaggtattcagggtatccagggtattaaaggagaccaaggaacactttggttaaacttctcccgtaacccaggtcctgctgatgggcgaattggtgattacttcatcaataaatccacattggaatacttccagaaaacatctgctaccgcatgggcttctctggggtacatgggtggaggaaacgtttatgatacagcctctaccattccgcaagctcgaacaaatgctgggtgggttgatgttccggtacttgaagcaccagcagatacaggctattatgtccgtgtagacaatgcgtggaagaaacttgatcgttacgatcttctggttacttctacaactggggctatggatgttggcgtgtctcaagtcttcaaggttgacggtacagcaaacaaaaccatgagcttcactaacctacctgcaaacagagcaatgaccatcgttatcgtgttctctggttccggtgcgtcactgacgtggcctggcaacctagcatggtcaaacggcacagcggttactctgggaactacccgcacggttgttactatcctctgggacggtacaaacctgacaggtacaacctctttgactgtcgattaataaaggggcttcggcccccttctcaaggagagtaaatggtagtttacgcatatacacctcttatcagaacgtctgatgggaaatatccggtatatctttctgacttcagagcggataatccgaacgtgagcaccggttcttggatctattctgaaaaccttgtcgagttaggttacttcccggtaattccgaaagaaatgcctgaaggggatgtggtcactgaaggcgctccacatttcaatgaccaaacccaagaatgggaacaaacttgggatgtacgtgatttcactgaagaagaaattgcggccaaccttgtctctgcaaaagatcagagaaaggctgatgcacaaactgttcttagcggggacattaacatcggtatcccttatccttacgatgagagggagtaccaagttcgcgtcaagagttttgatcttgcaactttgttaaccatcaagaatgttttggatgcagatggttctgaaaccacaaatgtctatccattccagttcctcgatggttacaaggctgatttcacccatagtgaaatgacagctttaatcaacagcgtatccagatctcattacgagttgatgaagtcttactggacttacattgatagtgtggatcaggcaacctctgttgaaaatattccgcaattaccttcctcattcctataaggagaaataaaatatggcaacttctggtgtagctggtcttgtttatgcaaccaaacttatcgatgttggtactggtaaatcaatctctgttgctgacctcgtagaaggtggtgcaggttacacacttccagcagcaacaactaccacgctcggtggtgttaagaaagcttctggacaggcagattctgtagcaaccgatgttgaaactctggtagcagactttaacggactgcttgcgaagcttaaatccgctgggattatggcgtaacaaaaggcccttcggggccttttattttagaagcttacgtacacctgcttccatattcacattgaccacggggtcttttccgtctttataataggtgcagatgtacgcccctttgaatccttcagttccataaaggatcgcaacatcattcaaatactggtatgcttcagcctgttctgttatctcatccatcttacctgtctgaacaactgagacgccaggtttgaatgctttcctgaagcgttggtcgcaaccgagacgaacaagtcgatggacgctggcagttttctcttcaggagacaaccaacttgattcaattgctttgatgttattaacatcaggatgcttcattacatacgtaaaagctcccgccccgataagtgctccagcgataattccaatgataacggccttagtatgtttcataaaatgttctccagttttgtttgatgacttaaagataacagaacttaacgtcttgtcaagtgtttttaatgacaaatagaatattttgtgataagatattgattaatagaagagcaatccaacaggagcgaaaatgacagaccaagatattattgcatatattcgactgctccttgggtccattcccccagaggttttaccagacgaaacaattctggcatttcttgctattgagaaggttaaggcaaactggcccaaccctcaatcaacaacctgcgacatgtggcgagttgtttataacacgctcgttgatgtggtacgttggttgatccttcaagaagtaaactctggagaggcatctatcacagaacgcttggaaaagatcggtgacgaaacaatccaggtgaaaggtggttctacataccagaactggacagatttcctgacctggttacaggccaatcctgattatgtggacggttgtctcagcgcggtttccagtttagtcatcattggtggtgtccgtcaagatgaacactggcgtgtgaaagggaacccgaactcaagaggtccgttcgatgttgcaggcattgtaccccagacaggtgtaccaggaattcctcgcagataccctcaccgctggcctcgttaattatccttcgcttggtcgttgattttgctaagataatgtggtaaaatacctaaacggatgtggctatgagaccaaaattcacaagtaagcaagatctgagccagtttgagaactttttcagagcaacccaacaacttgattcgcgtcaggtttcatatggttattatgacgaccctcactactcaggtcttaatactgcaacgctcgctgcaatccatcaagaaggttggaatggtcttcctgcccgtacctttatgacaagcgcagcagttgcattcaataaggaactggaaaaactccagaaggaacttttcggataccttgcttcaggcggtcgtaatccgacaccgatgctaaacaagatcggcaaagcaggtgcaagaaagataaagttcgttatcgactccggtctgtttcctcataacagagtatccgatgcgtgggccgatgtcaagggattcagtgaggcgatgtaccactatggtgaccttaaagagtccacaacattcagagtatccaacagcagagggtcgagggcataatggctggttacagacttattggaaaaaatagattaatacctcgcccaacctttacagggcgacacagacaatattcaaaagttgacgcaagcaatccatacgaaaaccaaggtgttgaaattgagtatgaagagtttgatgttcttgagtgtgttgtccaaccattaacaggtaaggctgcaagagattatacatcacaattgatgcaggaaggtggtagacagtatgactccttcaccgtttattcctctgtgatgctcaaaggtcctgttgaaggctcaaacgagcttgctgaccaaatcaagctgatgaattcccgtggggaaatggtgtggttcactgtgattaaatctgatgcttatcagactacaggtgtcgcccgtttcagagcttacgtagtatccgtccccgaagggacgaacggaggaatttaatggctggattcaccaattcggatgaaatctttgacgcccttaccaatacagtgggagcattctgtaaagaaaccacaggaagaaaagttgtattggcaggtgaagatgagattcccaaggtggatggtgaattcattcttgttgacctgacggcagttgaccagattgactggcagtctgacgaaggtgttgatactcaaggcaatgccatgacggtgcataattatgaggttgtttacaccctcacagcctaccgtggtaaagctcccaacgccttaagcagggtattgcaagcaatgaacctaccgttcatttatgacaaatatttcccaaccaactctccttttgcatactcgtcctcttcgacaatttctcgtttaagagttccattgaatatgcagaagtttgaaacccgtgctgttgtcttgatcacatttaacgtgtgcttcatcgaaacagataccggagctttcgaagaactggagaagatcaacgctcaactcgtttatcactacccagcagaaggctaaagaaaaccactcggttattgataagcactggcttattagtgatcgtatagggggcgcaagcccccagaatacagcacaaagaggtgctggtcaataactgtatgtacagaaataaagaagaggaaaccgatggcttataatgacaaggtggttgacgttacagtcacgcttggtactcaaccaatcgacaccaaagggtttgaaaccccgctgttcctggctatccacaacgtcttccctgaacgttttcgcgcttataccgaactcgatcagcttgtagatgatggattcgctccaggttccccagcttacacctttgcaacaaaagcgtttgctggtacattccgtcctcagtacctgatgattggtcgtcaagcgtttaccaataccatcgtggacttcacaggacaaacaaacactgataccgaaaacccggtggctctgaacgtagtttccggagcttatcagaccagcgttattctttcagtgactggtgcatctaccccaagctctctggcaactgccctggcagcagcccttaatggtgatgcaactctgacaactgttctgactgctacggcaagcgcaggcgttgtaaccatcgctccaaaagatgatggtactttcagtattggtcgtgacagcggtaacatgacaatcacaaactcctcaagtgaaactgtgtcgtctgttctgccacaagtcctgactgcaactgagaactggtacttcctgagcactgaatctcacaccaacgcttcaatccttggtgctgctgctttcgctgctgcaaactacaagctgcacgtttattcaactgctgacgaactggttaagactgctggtagcaactccattgctaaccaactgaaagcactccagtacgatactaccatcggcatgtacgatcctcttgctgatagcgcattcccagagggtggaattatcggtgcaatggcttccaacgacccttcttatggtgactcaatccacctgaagacaatggaaggtgttatcgctccaactctgagtgtgagtgatcgcatgaccatttgggaccagaatctgaacttctaccgtatgattaacggtgttggttccttctacgaaggtaagtgtgcttctggtaactacgttgacgttgttcgtttcggtcactggctgaaattccgtacagaagaaagtgtgtttggatacatgtctcgccgttctaacatgggtctctccatgaagatgagtgatgacgatcttcctaacctgaaatctgtcatgatgaacaacccgatcaacgttggtattgcaaacgggtctatccttactggatacgatgacgttaacaaagtgttctacgatccggtgatcacaatcccgcttcgtgcgaacatcccgactaacgatctggctgctcgtactctgaacaacgtgaaagtggagcttgtgtacaacacgccactgcacttcgttaagatccgcatgaccgttctgttagataaaacagggtctaattccggaaacggtcagactgtaacagcaggagtgtaataaatggatacagctatcctaacgccgtatgcgtatgaccctaaaaaagtcaaactgtacctgatgacccagcgtgtgactggtttcgccgcagatactaaaatcgtcgttgcccgtaacgaagataacatcatcccccacatgggggttgatggtgagttatccgccgcactgtcacgtaaccaatctggtgtcatgacggtttcccttcagaacactgcttcttggaacggaaactttgcaaactggcagaaacaagcctctatcaccggactgattttcttccctgtccttcttgaaggttctcagggtatgggactcagcaccatcggttggattcagaaacaaccagacctgacctacggaacagaagtgggccagatggactgggaaatcggtatccttgatgcttggttaagcccagatactctgtcttccgcaggcttcggtcttgctggcctgactggtatcgtttaagtgtttcgtgtgccacatggacgtggcctttatacacgcatggataactcaaccacaaagacgcaggagcgtacatgaatatcagaccgacaactgaaatcgacctcgcaggtcacaacttcattatcacgcactggtctccaacgaaggtcatgaaaaaccttccgaagatcggtcgttatgtagcagtcccaatggcaaccatttctggttccatgatgactggaggccagaacctttctgatgccctccctacagctattctatacctctttgaacagatggagcaagatgatctcgaaaaacttttcgcattgattcttgaagatgtatccgttgatggtatggcgggtaaagtagatattgacgctctgttccaagacaaaatgttagacctcatcaagctggttgctaaagttctggagattaactacggctgttttttcacgaaagacggtttcgcagaccttcagggacttctgggacgcctgggacagacccatcaagtgaactcggtggatcaggcaatggaagtggcagcggagtaacaccgtccaaaatttcgaaagtcgtcctgagagctatggattatgcaaagaaaaatagctcactgacttggttcgattacttatggtgtcgtgctctgaaaaacttcaagggggaatcctatagctcccttgaatctgctgatatggcctatctgctcaagctgaatgaatacctcgatgtggaagaattcgtttctgatgtccacgaaagagaggaagaaagtaaagcaagggctaatcaagctgcaaacaggccgcgccgtggtagaagaggttaatctcaagccgggttccttttcgggagcctggcttttttattgagagggaatcaatggcgaatattatcgtaacccagacagtcaacaaagtcacatgggacgtggacaggacttctttcggtcgtgccatgaaagctgtgaagtctttgaagagtgaatgggaaaaagctggcagggcgttctcttccagtaagactgatccagcagcaacattaagacgttctgcaatgcaggcacgtcttgtcaacaaaagattacaacaaacggaacgtgcagagcaagcgaaaactacagcccatgctattgcaatggctaagaaagaagctcgcgcccgtgaagcaatcgacaaaattcaaaaggcccgtagaaagcaggctgttggtcaactgaccgcaaaaagatctccagaatctcaagcggattacaatggcctaaaggctcgtctccgtgagatggaaaagacaggtggtggttacggcacaaatccagcaatttccgctgcacgtcaagccgctctccaagagcaactatcaaaacgctcgaacgccggaaatgctacaggcatggttggtgacccaaacaaagtttacgacccagaactacacgctgcacaggttcgtcagatgcaacgtggaacaagagttgaaaaggaagtcaccaaagagcaactccgcgtccgtgagcaggcccgtaagaaaatggaagctgaggatcagcgttattcccgttatcttgcaggtaaggaatctacggttgcaaacgcaggtgttcgcctccgtgctaaatatggtgacaattatgcctcaaaactgaaaggttacgattctctgaaagagcgcttccttgacagtaatactatgaagtcttcaaatttccgtgctgaacttgcagcaatggagactggactcaagaaggcaaatgcgagtacacttaccctgacagacgggttgaaaaaccttcgtagcactttaatcagcgttagcgcagcatacggtgcattcaatgccgctgcaagcgttgttaaagctggtcagttcttccagggcatggaagccaccatgctaatggtttctgatagctccgaagaagctgggaaacgcatgaagtttgttcgtgaccagtcttaccgcttgggtcttgacctcaagattgcatcgcagggttacacccaaatggcaatcgcagcggatggtgttcttagtaaatcacagaacgatgaacttttcaaggcgttctctgaatactctactgccttacaggttgatccggtcaaataccaacgtggtattaccgcaatccagcagatgatgggtaaaggacagatcatggcggaagaactgaagcagcaacttgctgaaggtattccgggatctttacaggtgttcatcaaggcttcccaagaggctttcaatgattccaccatcgacgtaaccaagatgctcgatatgatgcagaagggcgagttgaaagctgcgaaggtcctaccttttgtagccaagtattactccgaggctgcaaataaaggtggtgctttacaaaaggcattgcagggcaaccgtgttgcgatgcagagactgaccttaacatggatggactttcagaacaaggttttccagagcggatttggggatgagttaacaagcgcgttcaacgaacttgcaaaaatccttgactccaacggggagttggctcaaaatctgggtcaattcgttgctgggttcactgccgggttcatggagatggtctataccgtttacaatacctttgtgctgatccaaggcatcatggaacgttacattccgatcttccgtaagaatggcgaggagttatcctctgcatggaaatgggtagggtggggtgttggtgctctgttctttgcttctgctctgatccgtgtgttcggtattctttcgaagattgctggactctccggagctttaaaattcctaacaacgatcttcggtggtggggatgatgaaggtggcgagggcggcggtaagaagaaaagaaatggtccacgcttcggtaagatgggtaaagctgcacgttggcttggtctgtatgggttgattgctggagaaagtatgcttgccggggattatgtcttcgaccaagctcaagattacagtgaatcaacatacggcacagatacaaccgcaggtggtaatctttacaagaactcgtggatgggtaaaacttgggactttattactggtcagagggcaatgactgatcagaatagactcaactacctgaaccagaactcgatgatgcctggtgctggcccgacaggaaatgctcctatggtcattccaaccgaacctgtcaatggagagatcacaatcaagattgatgcaggtgagatgaagaacatgatcgaccagcagatcgaagctgcaaacatggggaacatcaacttaatccttggtgtcccgcaataatttaaaggggcttcggccccttttttattgttttatctcaagatttatgataaaatcgtaacatgtataatgggaggactcatggcatttgtatccaacaaccagtccaaaccgcaacagggtaaggccacggctaacgtcgagaaaaaggtcaacacagcccaagaagccagcggtgaggtgcaatatacgctcttcgccagtggtttgaactacggcggtagaaacgtagaactcaaggacaagaactacaccaacgacctcgcgatcattttcgacgttgttgaacaacactcttacacaaggacggtcgataagacatcctacgctgttgaagaaaaggtaaagttcagtgaccacggtgtcatcgaagatgggaaattttctttcagtgcaagggtgaactcatctcctgtttatcttatccaaaacaactacattgataaagatacagacgatcaaaacccggttgcctcacgccgcccagaaaaggcacttgaggtcctcgaaagacttatcactgatcgtcagatcgttaccttggtgactgaagataagatcatcgagaattacattttaacctcgatggaggcttctcgtagcaactctgatggcgctgcattggttttccagcttgagttcacggagttccgcaccttcatccttggcaaaactgcgatggcgacaatctattcggaccctaaaaagtctggtggtaaaaccaagcagaaagggtctgtgcagtcttcagctaccgacaatgaggttgaagtcactgctcgtcgaaccaaatttgctggcccaaacaaagatggatggcaagcaattgctgattcaatggatactggaaactttaccaagcaagaccaagttgttggtgtgatgaccccagatggtaagattaggactccagaaggctccattattgattacgataaggcggtaggtaaataatgtcaaagatcacattctcatgggatattgatggttttgctgaccaaactatgcgtgtggtattggacagtcaaacatacgagatgagattccagtggaacgagagagatgaatcttggctcgtttcatttggggatgttggctctgatccaaccatctctttcaaattaacaacaattttcgacatctttgccccttttaaatatttggaaaacattccttcagggcaactgcgtgtcttttcattcacccagtcaaccaaacgtgtggggagatacaatatcgggttcttgtctgacttgcaactcctttattcatctcctgacgacgaggtaactgaagacgaggattaacagatgccgacttacagaacacgtacattcagactcaccattggcaaacctgtttatattggacagaaaccaacgaacatctctgattataccaaccaagatacaaaaaacgcgtatgttgtcagtaacgaaacaggcgctgcaaacatcgagtttgaggtgaagaaggataactccaaagacccgaataaaggttatgtcacgctttataacctgagtgacgaaacagttagttatcttgatgctaaccagagagagtctattgccattgttcttgaggcggggtttgatggtgaaaaccagatgattttttcagggactgttgagtttgtccaggataaatgggatggacacaccagacaaacaaagatgatcctgggtgatgcaacgaccaacattatgactgcaaagaccgctaggtcttataagaaggggactcctcttgatacagttcttaacgaccttatctcagacttgaaattaccaattgggaaggttgttaagttcggtggtcagactctccagcagtcaatggctttcacaggtaacgctgcgaacaatcttgaaaggctggcgaagaatactggatcaacattcagtgttcaagatggtgcagtttactggacaacacaaggcaagaggtttaagacggctgtttttgagatcagtgcagagtcaggtatgcatgattcaccaaccccgcaaaaccctgaaccagcaaagcgtaggctggaaaagaaaagtaaatccaaaaagaaaccaaaaaccaacaaaggtccaagtcgtgccgagatcagagaagacgcaggtcttgttgtggtgacagagcttaatggtgcgatcattcctgaaagcacgatttacctgaaaagtcagaaatacacagggttttataaagttgtgtacctgacccacaaagggcaacttgagggtggtgattgggtgtctgagatcggtcttgcagaaacccgtggtggagtagtggaggaataatggcatcaattcaacgtatggatgctgcgcttaaccaatggttcgcaaggcaagctcgcgacatccacacaggactaagggcaagagtggttgatgtggattacgcaatcccttctgccactgtccaacccttagcctcaacaaacttcgacgatggcaccgtagacgcatatcctgcggttttcgatgtcccgctatccatgccttcagctaatggaggaaaagctcgcctgacgcttcctgtgaagcctggtgacgttgttggtctctccttctctgagcgcaatgaaggtgacgctaatgatacgaccacccacggactttttccagggtggtccattatcggtgttcatagtgatggcaacgccatgactatagacccaaacaatgttgagttgtggaacgaccaagttcacttctccatgacgcctgaaggtgatttcacattaactggtccggttggaacgttcattgttgataaaactggtcaaatgtccttcaccaatggtgcagcaacactgactgcaaaggtggatgggaacattgaaatgaacggggcaaaagtcacaccagatggcaactttattacagcccgtggtgtgaatatgaatgatttctatgattggtttgtccgtcataatcacttctacacatggacagatgatggtggttctggtaataccaacccacccaacaaataagaggtttaaatggcaactctttactcagatctccttatggacccagttacaggagaccttgatgtctcctcggggcttaagcttatcgagtcaaaccagaccagccttcgtcagcgcctgtggctaagattcaacatttgggctggtaactggtatttcgatgagacatttggtttcccataccgagcatatttaagcaaaaaagtaatgaagactgtccttgacaataagatcaaggaggtaacacgtcttgaacctgacgttcttgaaatcacctctttctattcaactatggatagaacaacccgtagttatcaagccttttatgaagtcacaaccaaagaacaggaagtggtaagactcgcttttgtaggtcaagacgagtattattacccaacccctgatgaaggtgcaaccgttctttgtgatgacgatggttggatcacctgggctaacaaactttattacttgatcaacttccgtcttcctcgcactggcgatgctacatggtggaatacttggtctggtgctgatatggataacccaattccggttggtagtttacttgatgataagaataatatcatcaccacagaggatggcaagtccatcaaccgtaaccactaaggggtgaataatggcagatgtttcttttccaacggtgaaggtctctgaccttccttccgccgtcaccgtatctggtggtgactatgtagttatggatcaggcagacacaaccaggaaggcttctcttgacaccatcatgactcgtatgggtattatgaaggttgtcttcttttctgagggtgggttccttgaatccaagaaagaccttgcattctttgatacgaatggtaagtattacacatggaatggtgtttacccgaaaacaattccaatgtcatcttccccgtcaaccacaggcggcatcagtgagaacgcctggcaagagttcggtgccagtggtggcggcggttcaacaggtaaggttgtcaatcttggcaatgtccaagggacagcaacatgtaaccttaacaggggtgattcttttgttgccaacttgacaggtggtcagtgcgttgtcataattaccaatccatcaacggctcaggatgtatctcagtcgtttaccttatccttaacacagggtacaggggcgaatttggtttcatggcccagtaatattaagtggaattatgggcgtgttccagttctttcttataaaaccggggtccgagacatctttcagttcgtcacttatgatggtgggaatagttggttcggctcccttattatggcaggagttgagtaatggcacagttacgccacaacattgataatgtttttcaattgatcgatggtcacatacagttccttgaaagaaacaagggagagaccattgacccgacagttcagcactacatcctgaacttacagaatgttttggctaacaaccgtcactttatcaactggacggctcaagaagcccagcctaacggtgatgcaactaccgagggtcagtctgtcttgatcctcggttgcgcatatgcatatcttgcaaccaacgaccctaaatatctggaacttgcagaagatttttggcaagcatatatcgactggttctttgctggtcagccaatcccagatcctccggcagtgtatcgcccgaactggatcattaacgggaaagagccaaggcttgcacattacccactgacagacgatggatacccaacccacggtgggtttaagggtagcgttatgtcatggacaaatggtaagacgttaattcctcatggtgctccacattggggagaataccttgacaaggcttggttcgcctttgatggtaatcttggatggaattccgttaacgccacagtatatgctgctaacgcagatggtacgacaaattgggatcagtatgggtctcagtgggatgtcgattggatcattgacagactcggcagaaaagttgattgggacggtaatattcttgaagagggtttcccagaggcggagtgggggactgttcaactcaaagataccacggtaacaggaaatttcaaattcaactatgcaacttgcaaccctgtagagcatggtgggtacttgatggatcggaacacgatgtggcataaccgaccagtcaacgtacctattgagatgggatttcaggacaacgcctctgatgctgaaacttggtggtgtgatgccaactatgttatgtatcagatcactggtgaacgaaagtattggctgtgctggcaatcttctctgattgtttgtgacaattattccgatattgaccgctttgataagttcttccgcaaatcaacatttgcaataatccctttcaccgatgggatcagttatgattactcatacccatcttcagcagtccctgtatacaccagagactctgagggttatattggtattcgtcaaaatgtggcagcacagacaacgcttgaacagcaggctatctggttccgtgttaatggagactcaaaattacgtgtgcagtttgcaggtaaggacgatcttggcaatgggttgttattcagaccagaacttgacctgaacaaaacgaagacggaggaaggtcgtgtaacttatcgttgcggcttaccaagaggcacagactctattgtgtctatggatgtgccactgtccaatttcgtcaggttgaccccaccaggtggtggcaactacatagtggctgatccacgaatcgttgtcgattggggaacgaacacaaccgttgactttcaataccaaacaggtattcttggtaggatcaacgatcaggcttgtacacttatcacagatgcggatggtggttgcactattggattttggttaacagatacagagactacggatctgaatgcgtttacttatcgctcgtatgccgatgatttcaatatttcaatcacagatgataaccagtggagatggtgggctttattgcctgctacgaatggtgaatggacaaccctacagttgaacactgcaagctttgctttgagcagttatcaaccggatcacccagacaccgatccaagaccaacaaacattaatcttcatgggctgaaacagataaacttagctccagacaccgatccggttgatggggtaagtgcaaagattgattggtattgtgtcaacgctgtccctgaactgtatacctcaaacaatggtgacgattatactatgtattttcgtattactgtttccggtgataatccgtacaatgcaaaacttggtgattgtacaattattgactacaggactaacagtctgaactatacccctggactgataccgttctcaaacatcagtgatccgaacactgcactatacgatgggtggcgaggattaccatatccggggtatcaataccctaccctgtattgctttaaggatctggctattgactggacgagattgaacaatactattgacttcctttatgactcacagatgtggttttacaacacattccaccctgtgatgccaggtcctatggctcaggcttttgtatgggatagatgggatgctcgtaaatatggtgaaccaaacaccttcacaatgaagcattggaatgagaaggcttgggatggttatgaagctcgtgcattcttctgcgtttgccgttgtatttatgaattatctcaacgcaaagaggctattccaagtaagttgttcacggttgccaaaaactgggtggattaccttaaatggttccaagacaacaacgaaggaaggactccgaccatctttaatccagatggcactgttcttgctcctgttgatgacttcacaagtcatatgtctgcattgtttatgggtggttgcgccatgttaggaatggcgggaatgggtacaaggattccaaacatcgaccttgtggcagagcgttgttttgacctgatccaggaaaactacatcgtcctgacccctaatcaccctatgaacggaagttggtctgttgctcctcgtgcagatacagacaatgggatgttctttggcttccatgctggagaattgttaagaggttttggactgtacgctatgtacagaaaccttacaagataagaggaattaatggcagatctattacctaccgtcaagatttcagatttaccgaatgcgacggaatctttcgagggagactacctggttgttgaccagtcggatgcaacccgtaaatcaacatggtcagatatgttctcccgtttcgggttgatgcgcctgttttccttccaagaaggggggacgcttgtctcccccaaagatcaggtgatcgacagatcaaccaacaggatctatcaatggacaggggcatacccgaaacttgttcctgccgactccacaccggagactacaggtggtgttggtgaaggggcgtggtcagctaacgacccatctctacgtggagaccttgcaggtgctaatggctcaacctttatcggtggaccagcgggaacagtggctcaatcactcgatggttttgttacccctgcacaattcatggggaaatatccaacaacgacagaggctgtaacagcgttagctgcatacgcaaaagagaacaaaaaagctgttcttgcatggggatggaaccttgttcttgagacaagtgtgtatatcgacggtgttgaatggtatggtggaagctttaaccagactggcggcaacagatacatgtatttatcaaacagcacattccgctgggtgaccttcacaggtgtttgtactcgccattatggtgggcgtctgatcattacagactcctcatgggttaacaataccaacaccgcagcgatgttactacaagccctccctatagaaggtacaattgacattctggatagtgatttcagaggttgtaaatatggtatccttcagcaaggtacaggcgctcttgttactcgcgcacgttttgcccgtctcaactttaacgatttgacaggcgatgctattgagtgtaacgttgtacagagacactataaagcgggtggtttgacaatcgaagatattaacatcgacaacatcaacaatacagataactctcctaactggggtattggtatcggtgttgcggggcagggaccgtatggtgctaacgcctctgatgaccaatatgttagtgggatcatcattcgtaacgttaagatgcgtcgagttcgtcaatgtatccacttcgagctttgccgtgactttaaggtcgagaacgttgaggtttatcctgatgcatccgtttctaacggaacactgctggcatccggtggtgtcgtatgttatggttgcaaagactatatcattgatggtgttcgtggcgaaatggtcaacggtgctacccgattcatttattttgggtggggtgttaaccaaggaacctttgctgctccgtgccgtgactttacactgcgaaatgtacgtactcatacgggactggtagatattccagttagtgctatggatgactggaccaacgatgtgaaggttgaggacattgagtgccacactttcaaatatcgcggtcttgtctcaaaacttcgtcttgctgacatccgctgtaaacagtttgatggtattggcgactatgaggctggacagggtgaggcaggcggggcgatgaagcgttgggcttggtgttctgctgagatcattaatatcaatagccttgatgataatggtgtcgctaacggtaagttcggtcaggtaggctttgaccacttaacaacatacggttgtaacttcgatgtggttcagcactcaaagacaaacggaaacagaggtgtcatactgcttaatgctggtaacatctatatctctgataatgatgattttcctcaaggaaaggaattcgttaaaggggacatcattctgaagaagactggtggtatgtttgttgttgagacagggggttcttacattgaacctaatgatttcatcaaggcaactgtggttggctcaaaaacgattgagtgtgcagcagattcaagtatccgacaaccttgggctactcgtgcatttaaatctgctgggttgcaactcaccatcccaggcgcaggccccggtggtgcggatctccagacaacggttataagagcgccatatcaaaaaggtgcttggatcacaccgttctatctggacattgcagatccaatccagacagccacacctgataacacggctcttgtttcgacaaatcccgtagtatacagcgaaaggacttaaataacaaggggcttcggccccttttcttattataagcctttataattaaatcacaatatgataaaatagcaacatcttagagcaaaaatctagcaagaggaggcgttcgtggctgctcaatatggattaaatgactacggctttgcgatcccatccctcgatgatttaatcgcagataccaagcagtcgctgatccgaacttttggtgaaaacttcaacactcaggctaacactgttgttgacaaacttaccacaattttgaatgaaagagaatatcagttgatccttctggctgcggctgtgtattctgcacagacacttgcaggggcagaaggtatttatcttgatgaactgcttggtcgtcgtggtatttatcgtcgtggtaaaaccagaggatcaggtactatccagatggttgttaacaacaccgtcccgtacaacatgatttacagttcttcaacatatagcattgacagtggtaacttcgtactcacgcaggacactcctgtcgcagggaatatcctggcgcaacaaatccttaaccaagattgggttcttggtaactatacgttccagatgattaatcagaacgatggttcaacaaaatcaatgaacttgacgctaagtaataaggtgcctaacagccctcagttaaatgcgttcatgtcatcgattaaggatttcattgttgacaactccacacagttaaacgaagacaggatcttcattgactctgcgggtggagcgatgtatatcgggtatgatgctaacaagaaaatgatcggacttaacagtcgtgttgatttccgttcatcacccgtagtgggccagagaacaattaccattgaagtaattgctgctgaagcaggggctatttctcgtgaagcaaatactgtaacgaatatcacaccgacaccaagcggttttatcagcatgaccaacatgaccgcctttaatgacggttccgatgttgagacagacactgattacaaggttcgtgcttcacaaagcaccgcagcaggtgctgctgccactagacctgccgttatttctgccgttttaaacgtcgagggcgtcagcaaggttcgtgtattctcaaacaacacaggggaaacagaccagtttggtgttccggcatataagtttgagactgtagtttatggtggttccacagaagaaatcagtgaagcactttataacacaatcgcattgtccaacgcaacctatggtaatgttttttatgatgttaccacagaggatgatcagacggaacgtatctatcacagcaaagcacaggctcgtgagcttgcagtccgtgttcgttataaaggaaagctcctgtccgtgacagagcaaaacactatcaaagatgcattgaaagccgttgttgatcctctcaacattgcagatacactttacaacatccagttggtatccgcagttggttcctctatttcaccagggcgcttcacgcaattgttggtggatgttaagaacactgaccaacctgacagtgcttatactaacagcgatgttgttgcaggtatgacagaagtctttgctttagatacagacgacattacattccagcaaatcatctaatgaggtaagtatggcagactatttaaaggatgtcaaccacatccatactctgccagatttcgttgagggaggtattcaatacctccctggcgattttctgaaagagaaagaaaaccttgtcaaatttatgacggtttatctggaacgcctcaaaaagcttgatgaaatgtgggtcaacttgtctgagggcagattactgaaaaatgcgacaggtgtcaaccttgatgagatagggaagcaggtcgggattgagcgtgatggcttgagcgatatgaactatcgtgccatcattatcatccttttggcaagtgctgcgaagcacgggacaagacctgaagttatcgatacccttaaccagttgttcggggaaggtaactttaccacatacaagggtgataactaccgtttcgatattaacatttccaaaacatgtttcgaattggagactgctctccaggagattcaagacatgttgcctatgccaacacacctgagactaacagagtcaactggtacggcttttggattcgcaggcgataaacatgcactcggattcggttctatccactcaggaagccgaacaggagagggtggtcttgctcacctgacgtatgtgtctgatgaagagaataccttgatttaagggagattacaatggcagcgccaacagtacctattgagatttgggcttatggagatattgttcttcctaacacccatgaattaaacaaagcacgtcctatcgatgacctgtggaacaaaggttgggaccttggtgaaaagccaacagtcgaagaatttaactacgttttaaatatgctgactgcatgggccaagtatatcactggtgagcagatccctggtctcgacagtcgtttcttacgtgtgaatcagaaccttgcagaccttgcagacaaggccgcagcaagaacaaacctcgatgtttggagtaaaacagagtctgataccagatatgtgaacatttcaggcgacaccatgactggtgcattatctgttccacgcctgaacctccaaccatccgaatcagattacgcatacatcacgaccaccaacccagcagcagacaccacattctttgattttgtagttggtgataatatcggtaatgccccaggtacgtcgagcatcgatagtatgcgtttccgcttcgtcccttctggtggctcaatcttcacaatgatggagttgaatgcgatcagtggcactgctgcactgtgtagggtaactggtaacattatcgcaagcggaagtataagcggtgcaagcgtcactgcaaccactgcaaacttcacaaacactaccgtaagcggtacgctgaatgctccaactattcagtccacaacaatcaggacagggaccttaacggcaacaggaaacgttcaagggttcaacgttgtcgcaacaagctctttaacaaccccatatgccagtgtaaacggacagtgtaacgttaactcccttgttgtcaacaacaactccgctacagttggtggacgaaacgttgtgagagcaatcaatggtgcaacggcagatggtaacggtaacgtcacactaaacctgtctggatttgttcagcagatccgtttaggtaataggtttgccacaggtgtaagtgaatccagattttatgcaggtcacgtcatgaccgggtgggctttcggtaacaagaaagaattgaggggcgcaacttactacactgcaccactacagtatctcattaacggacaatgggtaactgtttccaacctggactaaggaggatttatgacaaaggtatatggtgaattttcattatacaccccaacaaagacggacgagaacgccgcattcctggagtcaggtgcagttttcctgaaagataaagacggggaagattggtacgacatagtgaaagagttgacaaaattgaaagaggggaccaagttccttcttctgtcttccggtgatgtcgtgttgtgtgtgtcttctgatccatcagcatacttcccagaccaaatgaaggttgctgttgttgatgaagttcctgatggtattgaatcccgtttaggggctgtgcaattcatctctggggagtttaaagcttacaataaagaggctattgcacaggccgaagttcttctggacagtgaaatgtcttgggctacaaaccagattttagcccttgaagatttgatttccagaggacctactttggattcccagaaagcgtatctcgaaaagctaaagacataccgtattgatcttttagcaatagacccggaggatgctcctaatatcaagtggcctgaaagaccagccaagagcaaaaggattctataatgtctattgacttatttgctatcctcaaagctgtttggggcgttatcacgtttgttttaattggtgtcctgagaatcacatactcagattacaaaaaaacgcaagagcgccttgatgaacttgatagagacatcataaggattaaggcagagatggtcactaaggaaaaacttgacgagattctggataagaaactcaaaacggttcgtgatgacgtttcagacttgcgtaaggacattaaagaagacgtgggcgatcttcgtgctgacctcagcaatcagttcaagctactcatggagaatcaacgtcgatgataagttcagcactgtatttcttatgctttgcagtgctgctgcttaatgcagacaagggtataaggatcatgtctatttttggtatgatccatatccttctggagaacattctgtactggtggttttcagttcatatccagttctttgacctgtctctatatatgtcattatgttggttgctcgacataaccctcctgttcgccacagcgtgtgtattgtcgggatggaagaagaagctgatgctttccgtatcagtgcctgtactcttctgccagataatagtcatgcaatttccatatcttttgccacttgcattgagttttgtcatcaaatcttcatatcagaccgttatggaagtattgatcctctgtgcatcatttaaagacaatacggttaaagagtggctaaaaactgctactgtggtaagcctcgtggttcttgcaaggttcctacccatgttagttcattgagaatcttgaggaaatatgttaaaatcactattgaaatttattaaagatcttgtgagatcaccagtagaccctgagagggtttctcacacaaagttttggagcaatatcggcttggcttcaatgaccgcagttttcctttactggggattcaatggaacgttgaccgagtggtacatgtggatttatgcacccacagttgctgcacctcaactaatcagtaagctaatatctctacgctggggagtaacagaagcccaacgtacagaaccaaagtcagaccaataaggagactcttgtggcagacatgactcaatttgaacaggctgtcgatcaggttgttgaagactctgaacgcctccacaaggttgtcaacggaacggcatccgaaactgttgttactgaagatggtagcaccattccaacggttcgtaaagctcttcttgacaacctgttctttaaaacaccgcctatgccgtggatcgcgggtactcagaccacagtattcaaccagctttatgcttttaatggcacaaatggggttcaatggtggtatgcaccaaccgcaacagcaagcgcccctgtcgttttaccacaaaacccagctaacagtgttaactggagattgtacaacgacgcagcggcgatggcatctatctatgcaccaatcaacagcccgatcctgacaggaaacccacaggctccaacccctgcggctaacagcaacagtacaacaattgccacaactgcctttgttacaaccgctattgcaagcgccttgtcaagcatctcaggtggtagtgttacctttgcaaacctgtctgtaacaggtgctacaacactcaatagtttggtggttggtgggacaatcgaccttaatggccctgtaaacgcagataactcaacaggtcgtttccagaacctgatcctgacaaaagagttgtcaagtcttaccttcgtatttacagacgcagataatccgacattctttaagacgcgccttgacccatatgcgatccaaacccacagcatccagacggacattattgtcaacggaacagtggctgaagatgatacaaccatgtctctgacaggtgtgggtaataacgtcttcgattatgtgtatatccgtggtaacgcaagtaaagatcctacagcaccgagattaaaggtctcaggtacaactgaggtagaaaacctgaatattacaggtaacgtaacaggtatcaccttcagtgtcaacggacttgatatttcaccaaactctgttacaaccgcagacggtgtaactgtaggtggtgacttacaggtcagtggtgttaccaaccttggaaacgcaacaatcggtggccttgatattacaagtgatctgaccgtaaacggtaatacaacactcgaagatttctctgcgggtaacggaaacatcactggtccattcacagtgggtgggttaaccagtctcaatggtggatttacaaccggaacagcagatggtacaattggcggaaaactctctgttacaggaacgtctgagtttattgaggatcttagcgtacttgccgatgttacagtccaggataacctgaccgtaaacggtgatgtcaaccttaacaacgcaacaggaacaacgacagttaacaaccttgttattcagggtacggttacaggtctttctgttgacttgacaggtcagaacatcaacgtaggatctctttcctctactggtgcagtaactgccaatagccttacggtacaggattcggcaatcttaaccaaggcaagtgttgaattcctgacacttattgctgaggatattgatagctctacagcggcatggtccccaagtggagattccaacatctacaacgtaacagtggatgcggatttaacaattggtgcttggcctgaaccgacagatgctttttctgctgtgatttacctgactcaagatggtactggcggtcacactgtgactttagatcctaactacttggttttaaacagcgaaacaattaacgagacggctggttcggtgactattcttcaattaacctataatggtgttgaaggcggtgttatcgacactgtaattgttcgtcgtccgtaatgattcaaggctgtcttcggacagcctttcttttaggaggttttaatgtatcctattccatgtctcttcttgacattatctggaggaggaacagaaccactaccaccaggtagtgttaagaaggtggcctttacccgtggtctggttggtggtgctaccaaaaggtcaatggcgatcctcctgattgatgggagactctatacccaaggggataatgcgtggtctgaatgcgcaaacgggaacataagcccgtttaaggatcattggcacttggcggctaatggtgtagctgatgtttttggtggtggtagagcctttgttgtcaaatacaacaatggtggctggcagtattgtggggacaccagtcaattcactggtagtgggtctatctattcttcttggacaagcttcccttcatcaatcacaggcacagtatccctcgcaaatttacaaagtgtttcttgtgctctcggtaacacactctggcagatggtagatggaagactttatggaagcgggtcaaacacaaatggatgccttggctctggtaatactaccgtaatatcgatcccaagaagtattagtgcatcctctgtgagagcttacagcttaaatgcttgcgtgacatacctgaacaatattggacttccccgtgtttgtggggccacccatcagatagatggtacttcaacaacacaaacacaaaactttatcgatgttagttttgcctctgtgactgaaaccgtctatgttaaagagtggttagcgaacgaaacaaactcaatggctatcgcctctacaggtgttgatgatacagagcattatttatatacgaggggtatcgggacagcccaatactctaagaaagagggtattggtcctttcgagacattcagggttatcgacggtggtcagtctcatttcctgattgctgataacaagctttacggtcttggtgacctaagtgctcaacttggccttggcacaccatcaacaatggtgttagaaccgacccttgttccagttcctacaggaagggattgggatctttcgaagctgacatacattgtagacatgaagacagatgtccttaaccaggggaactctatcagccattggatggtgtatgacgggaacctttactacgctggtaacctttatggtttctttgggtcaaccgatagcactggtgagttcacaaacatcccagaagcatcctttggggggacaactgcggatgctatcaccacagggtctatcccatacgctatcaaagggtcgagaagtcaacttacgtggactgttgagccagcagatgctgagatttatgatatttcgttcacatcgagtgctcctaatatcgcaactgtagactcaaatggtatcatgaccttccttgaagagggtggttttgacatcacaatgactgctaaaacagggtctggcgcggatgctaaaacactcacagatacttctggcggttatgtttccatcttctctgtgactaccgattccatcccacaaaaggaagttggtgatgtgttcgtgttcatggataaaaacagtcctgactatacaccaggtccgaacgttgtcggaatggaaatttctccagccaatgttgatactaacttcatagacggagaattaacaactacaaatccggatgtggtgatgattgatgagggtggattcctttcctgtattgcagttggtgatgcccgttgtggtgttcgtcttatttacagggagggtcaggttgaggcatttgatgattcgtatgtcagtgtttcagacttcacagccccaccagatcctgtggaccccggcgaaccagttgtaccttctcaaccgcaataaaacaaaaaggagccgaaaggctccttttctttttattaaatgcaatggatgaagtttctaccatattgcagaccgattggggcaaagggtatatcgtcgtcaaagtccatcggaggctcataagcatccataggtggtacatcaacagtgccgctcagaggctcctgagaagtctgtggttgggtttgatccgcaggcttaccatcgttagtcaagaactcataaaacggctcagagagcgttacatacacgttcttggcgctttccaggatcgttgcctcagttacttccgatttggcattgaatcggctacatgcaacaaggattgcattacctgcacttgctccaacagcgtttgattcaacatccttaccagtacgctccgcaacgaaagccttcatgtctacagttgcacggtgaatggcttttactgtttccagttcatccttcactttgtaacctgcacccatcaattccttaaggccgttgataccgtgaccacaagctacaccaatagggtcataattcccaccagacttcttaccacctgagccagttccttgacctactgggccgtaagctttaaagccgttcaggattgtgccatcagcaagatttacaaaagctgtcaggcgaccaccaacctgtacctgtgccagttgctcatcagacagaacaacattaccagggccgttcttctcatcatttacagtcgccagattccctgcaatagcggtgatctcgccgtaaactttcaccccaccaccagactgttgaccttgagcactttgctgcggctgctgacgtggtgcaggttgacctgctttgctttcgtccagaatgttgaaagtcttgccactcagagagccgttgacataggtcttatcgccgttcgtgctcactttcagcgggaaagatgcaaccataccaggcagaatgtctttgtaaccagagtccagcttaacctgcactttgtcggtgtggcttgcatgtagcttcttctcccccatgccgatccactcaccctggctttgaggatcaataacgttgttattgtcgtccacctcttgcatcaagaagctgatggtatgtgttgattcgataacctttgcaggctgaccatttcgcgctgggatatgggtacgtttcacaccatcaggatctgcattcttaacaggtttgatgctgatgaatttgatgctgccctttgcgaagtggtttaccttgccggacatcggatctttgtattcgttaattacgctcattctctctcctattacttagtttcttcttgttgggtatcactgttaacacccaaaagtctatcgatcaccagatcttcaacctgactcagtagattcagggcaaaagacgatgcaccgtttaattgcagaaggttattgcggtgtccacgcacccatgcaagagcttcttccacagtagtgatgttgccgctttggataaccttcagcatctcatcacgcatacgctctgagccgatgaactgattcatctgtgctccggcactggaaagaaaaacaacagttccaaactgaccttcgtcgagttcgaggaagaacagtttttctttttctgattgggtttcgataggggttactgcctcagtcatcaatcctccgtttgtgagtgaaggggtatattacccctttcaactctgtatgtcaatagttatcgagatcttttcttacttaatttgattttctccagaagagcagccgcccctgcaacaccaaagacactggcgaaaaacaaaattatgatccccacaaaaatcgcgaacgggaagtagagtggtgccaagacccaccaccatgaccatgcaataaccccgcacagtttcaaggcgatgaataaaagcgccagtgcagataaaaatttcattacataaactccttgtttacattgataggtttaataaaaggatcatccatccacgatgggaagctacaagatgttgttcctgcgaccatattaccatcctccagtgccattacatatgtggcttttacaccacatttggcacagtcaatcgtggatacaaagtgctctacgactgaggtagtggaatgaccgtttggacaaacaaacgtttttgttattttcaatcacatcctcctgaagaactgccggagtcacaactgccactgctataacttccaccatcgtcactacttgacgagtgataaacagcagaggcaacaaaagcgctggttacaatgctatcgtcatcgttacgactgtaactcgtttcactgcgtctctgtcgtgcgagagaatcatcatccacaaccacacggcgacgtgggggtgcaggaggcggtggtgggcgacggttcctacgctggcgatccaactcttccattatctctttcagccgctcttctcggccctctgttaccagctttttagctgctacatctgccactgcctttttagcaatatccctgatctcattttcagtcaggggtttaagcttgtacttataatccccctctgggtcacgtcccttcagaacatgcacagttgaggtctgggtcactgtggtggtgttaccactgccaatggtcactacagagtttgaactaaacaggctcagtagccacttaaagaatttacgcataaaactcctccagtacagaccagattgtgttcaattcaccaccagacatcaggctccagatcaccatatcttgataacccttcttgcagacatcgacctgacggaaggctttatggaaactggttggattatcataatctacaggaagatattcaacattcttcttgaagtattccagcaccaactgctcttccagatttggattctcacctaaactggcttcgtacatttctacaaatttttgacctgttcgctcagatttcataaccattcgcctgtctccatttgttttggtgttaaggtcttcacctgcatatcatcaactggtgcaaaccccactactggtttaaagcaccgttctttctgtgcatcgaacacatagaatgatgccacagcttcaggttttgcacaagtggtccagtgatttttatacatgcgataaccatcactataagttgacaaggcattaaatagcgtaccaactaccacaaccagcattaaatatgccataactttatacttccatgtttccctgaaagataagacagtggcccaaacaaacatcgtaatataaagggcagtacccggcacccagttattgtgcatcgtcaaccattcccaaaatccaatcattacatagctccttcgtttttacgccatttgtaggcaccataaatagagtttaacaggaaagtgatccacattgcaagtaccgcccacccctgagtttcatggtggagcgctgtctgaatccacaaagtgactgcgactacgttcacaatgatccacacgtaccactgttctgcataacgtaccatcatcagataggttgccagaacagagaggatcgctgttgcggaatccagtccaggcatacttcctttcagaaggcttacaaattctgcatacaaggcgatcacaaccaacgttccaatcccaaccaaccaccgctgctttgtggtgaggtactttttgataacatccgcacgttcaccgtcttcagagacagtcagctttttcgcccagataatcccacctatcacctgcatcggagtaaatagcagagtgtacataatcgtctcaccgtacagtttgtacgtgaaggagatgtatgcgtacaacactgtcgccacaaagccccaataataactggaaagtttaccttttgcaacaaggatcgctccgataatacctgtcacagacgagataaattcaataaccccaccgcccatgatgatcgacacgagagcgatggaggctgaacagatgaacagccacagatattcaagtttcgaccaaccataaaagtcggtccaggttgtttttacgtatagattcatcatgtaatcttttctcctcataagtaagttgtttcctctccattttggaggtcatttagtattctgtcaactcttttttgcagggctttcgcaataagctcattataaaattcagatgaggagtatacctcgatcacagattgaagattttcagccttttgcttttgccataatgcatgagcagcaaggggggttgctcgcacgcccaagtattttcttttcccgtccaccctgcaccccgcctcatagaccttcctgttttcttttttggttacacccataggtaggccgctgttcttactataggctaatgcggtatttatgtatcttggaacgaacgcacatgcttcaggagtgtaatttctgttcccctccaaaagaatgtctttgtcaaattgaagatcaccttccttattcaaccactgttcgtgcaggggttgttgagaaacccactctttgaagacagaaaaccttaaccagtcatccgccacttggcatccggcataggtaggttgtcttttgtggaactgctttgaataacatctgtacaagatccctatccaaagttcatagtaagggcatctccattccaaaacctgtctaccatctacccacttgaaaatctgacagggagaatctgagtcgtttatacccctaccataaaccatgttattctccttggtgattatttactgcgatcatcagttcttcaacagaaacttcaaaacgcgctatcggttgaccagttatctttgtacctgccagacgataacctccggcatcatcagagatcacaagggagtgacctccagcgatgttcttatatatctcgatataagtgtgatcttttttcaaactcattttgtaaccctccccttggcccattctattgccgccatgattacatcacagtgacatctcttcggtgaacaaaagcatacaaggtctttcccgtccaagtcaagaagatcttgcaaagtaatttcacctttctggatcttctcccacaaccacccacggtacttttctatgacctcatcacgattcccaccacctttctcaagagggaatgggttggctagcttatgacccaccaggttaaatttcttcatggtgcggcccatgtagaccgcaccttcagggataaccttaccaatatggtaaaagttaagaaccttagccattaccaaccatccggctgtttaactccacagccattgcttctacccacgtagttatcggcacaccttctgttttgtcatcaagacaagagtctgtcagtagccagatgattgcattacgtaaatgctcgtcagacatatgggtgatccggacaagattaccttcttgggttttccagaccaaaacctgcttattttgatccatctaagtcacctttcaggtacgcgatgatccagtctgccgcttcttcatactcctcataaccaaagtatttgcgacgagaaaaatacgtgtcgtcgtcaggcacattcgtctggtagttgaagtttcctggtcggccccagtacacattgatctgatcactgttacgacactcggagaaagaaacttgcctcgaaaggtcattatcacacttgtgattccacttggttatagagaagccttgctcacgacagttagcgtaagcctgaagaccttcagccaactcaggggccttttccaaaataaccttcagaacaccaaaagcctgcttcatgcttgaattagttacgttcatcttattctcctttgatattcagcaatttacggacagcttcttcggctttttgagtacgctcttcgtaatcattgccggagatgaccaccaccttgcttgtatcataagatgccctgatcattgtgtcaagcaaagaatgcgtttctttacgcttttctggtgtatcctgcaaacgaagaggatcagcaacccacggaacctctggtgtgaggaacaggaacagatcgtagaagttgtagctctcttcacggctcagtgtccggaacaacaggtcggagtagtcgatcttatctgcacaaacaccagagaagtgtgtgatcagatttgtggtgtcggagaacattaccccacggtcaccccaaccagccacctccatctccttcaggcgatgctccattgcaacacgcaggtaatcctcacgactcatcgcaagctcactggagtgatactcacgctcacagatcagtcttccaatttcaggaatccaagctgcaccgaatgtgtgtgccaagtgttgtgtcagggtcgttttaccagtgctctcaacaccaacaatggcgacctttttcatgaagcgtttacgtgcaggccatgccaggttatagaaattgttgtacgggtcgttacgaatcatcgtagcagagataggaacagctttacgttctgcgtcgataacaacatgcttcgcttcagggaagaactcactgaagtaagactcgtactccggctcagaagagaaagcaaagtcgtatttaacgaaaggttgcttttcacggatcagttttgcataagcagcacctccttcagggtatccgggtatattcgactcatcaacgtagtcaaccttcacgttatccagaccctcatcggcaataacatccagcaagtcacgatagcgatcagcaagacccaactttggacgaatccactctggttgtgcgtcaacaaatttctggtcatacgacaggaacagatacaggcaactcacctgcgaagccgcctggcgaataaatgcgacatgcccgttggtcagcggtgcaaattttccgaagataaggccacgagtcatagtcatttgcttttctccatttcttcaacagcgtttgtgaggataatcatctgcttttccattttggaaactgccacttgcaattctgcaatttttacttcaatttctgccgcatctttcttagcctttgctctttccagaccctgtttgtaagcatccagcatatcagcattgcctgcatctgtgatcctttttgccaaggtatcggtatagaactctgttgcttgtacagagcaagaaagcgcgagcagggtggcaaggataatctttttcatgatcaccccttctgacatttgtagacttgtgacacacgggtcacagattttttggttgggttgatagatgacccctgataccagcgagactcttcgctcagaacattccccacctgagcatcctttttagggatcaccgtgtcgatacaggtctctcccatactatccttcatatgagaccaaatgctcagagagaaacgctcgatcttgttgcacacctcaaccttgcacataggttcggtctggaaatcatcatcttcttccgcatgggcggttgcaacaaaagccatagccagcagagcaatcgttaattttttcatttgaatctcctcttgagattatttattcagggttagtaacgagaccacttcacgcgaccaccgtcgcagatcagtttgttctcaacgacaactccatcagcactgtttgcgaggcgttgttcaccgttaggcttacaattatgggtgacggtatctgcgatgtcaacaacaataaacaccgcaacaacaattattccgacaatcaccaagggtttaatccaaggcatgtgacctttcataaggcgatactccagatatgcaccgtaaaggaagcattgattactgcacaaaccacgtacaccgcgcggtgtgtttcattttttgaaaagacagcgccaaagccacaccacacacatgtcactgccgccagcactaaaaagaaataattgattgcctctaacatacaccaccctccaggttatttaactcccctaaaaataaagcccctcaaccatgaagtcaaggggcttttacgttatttttgcaagtctttaattaccttggagatattacaaagctctttgtaacgttcccattcctcttcagtcaataaacgaacttccttgtcctctccaacattgttgtggtaattccagtctgcatccacatgcaccagcgctagtttacctttattcccagatcggtaactttccctgatcgtccttttaccgtcaaactccggtggcaagctgtggaggaagcggtacaaaagtttttcctccacagcatctgcaagataatcaatcgtctgaccataaacaaccgacttgatggcagcatcgcttagttccacatccacggtttgcaccgtggtttgtgtgccttttactttcatatcactctccgataatttcaagtgcaggaaaagcaaagtcttccacctgtttcacattgctttcattcatccatgagcaggcagcatatttaacgatactgattaccccgttggaggtcagcggtctttcaaagatacgctcaacaaccatgtcagggccacctgatttcaatctaaccaactgaccttctttaatcatacatcctcctcttatttatttatacctttcgggcattgtttgggaattctctcttttctgtatttccccagattatccgcaccgctgaagaaccaggtgagcttgaagatccgtgtccagccccacccccaaatttaccaccctggcgacctgtagggtctgccccaccagacccgcctcttgctattgttggtgaatatccacctctacctccatgaccattgaccccaacgccatagattccgacaccgccaccgccaccggagttctccccagatgtggaaccagagaagtaataaccacatgagccaccgccaccgcctccctgaccatcctggccttgagagtacattgttgatgctgggtatgcattaccgccatcaccacctttcccaatataccctgcggcaccacctgcgccactgcaacgttttatatcattggctgaggtattattcccacccgcgccgcctttatttatcactgcatcacccatatctgggtattgccccgtgtacggttcaggtcctgacccgaaaccagcagccactagtggtacagaaccacgaaacaaacctacaagcgtcgtcccatctgcattattttgtgtaaacacttgtaaaatctctccaggaaaaactgggatgttgtttctccacaccaagtctccacccgcacctccacgtcttggaagtggattagtttgtgctgcccctccttgaccaacacaaagtacactgacctcctcgacattggcagggacagtccatgattgtggggaggaagatatgttggtaaattccacattaccaacaggaatcgatttctttgtttcacttgtagcaagcatcatctcaaacatttatagtctccaagaacaggggcgtctgcccctttaaatttagtgacactcagcccagtttttacccgttaagtaagcacctgtgatatgcaccggagaacccatcatacgagcagctttctcaacacatttcaccaccatctcaccaacagggcaatactggatgtgtatcttcccatcttcaccaaagacgccctcatacaccgtattaccttcggcatccttgacattttcaccattctcgtcttttacagcctttctccactcatgcccgtcaaatacgcggccttttgcttcccattcttttacgaaagcttttgcatcttccagggtatcaaactcccacttcttcaagtatttcttaggaacctggagctggtattcatccaaaagtttagcgaggtcgttaatctcgcccacaccattacgtgttgccatacgttttcacgtaggatcggactatctaaccatccacaagggatgctctctttttcaacgccacttggtcgcttacccaagaattaatcttggctcaccttatacatcatgcttttacacatgaatggtcgtattacttggctaaaaatcctcccctcccctgttgtaaaacaaagagagaaatatttaccacccctgacacttcttatccaagggcatacgccagtaagagattttatccagtcagcaactagcaaacattgctctctgctagtacaaagacttaacgtatatctggaggatgacttaacacccttcttattcttcagggtcgttaaacttccatcgtccatccacaatatcgccaagtgctctggtccaagtctctttagtaatctaccactgaaaacttttttaccttcaggatacaaaatacgacgaagtaattttaggaaaggtaatcttttagttctaaaacccacctgttccttacccaagctgtttttccggtataaaataccacttggacaaaatttcttaatcttctcatatttcatcaatgtgtactctttctggtggatagagtgccacacttcgagatgaccatgcttggataaccatccatcgccaagtgtaatggcaatcagcatgtctcgatcctttttggtagttttcatgtatctcctcgcatatagctggattgttttaagtgaattagtctctgaacgttcttgtctctaaaattcctgacaagcttcgctgcggattagcatagtataacagtctaccaaaactgtcaaccttagccttcccgacaattaaaagagttattcgatgtgagttacctcacaaagccacaatgttacttatggtagtagatcaggcgacgtacatcgtcatcataccacccacgcttcaccagttcccagtgtagcaggatgccaacaaggtcaaacagtgatgcaccaccgttctgctggtaagcattcagtaacgagtgcttagaacgggtccaaatcttacgaccatccaatccaggaatataacgcttccctgttgcttcccagaagttctccagccattctttacgacctttcaaaccgaagttgctatcccagaaagcatcaattaccgcctgagctttgtcaagggagatgttcaacatcgctgcaatcttcgccgcctgagcaccgtacatgataccgtaggttacacctttaccgccgttacgtgtaacgagggttcctgaagctttggtgtacgcttctgcgtttcgtgcgtgagcgtctccgctctccatgatccgcaagtattcaccgccatcgaactggtatgcaccccatgcggcgatcatgccctctaggttggagccgtcgataccgacctgataatacccgtcagtaacaccccacaatccacgcatttcttttccgagcaacaccttcggatctggcttaggcatgtttgcacaaatggtgtgcttgcaacgcccggtgttggtgattccagaaaaacgggcaggaagcttcccatcaatcgccaggcgagggtggttgagcaaacctgtgtcattcttatcctcatcaatcgggtcgaggactgagcgacggttacgcagtgacaaccacttaacgatctgttttgccaagtgaacatcaatacgttcgaggttcggacatagcttgccgaagttatccttcaactgtggtgaagttggtaactgacgagctttgcgccggaacttcttgaatatttccgcatacgccttgtcagacgcatgacgatgatcaaacttgcgctctgagatgttgaatttgtcgtctgtgttatttaagtgctcaataatcaaagacttatactctgattcaccaagctcctcaatgtactttctgactaattcgtcaatctctgggtcagttctggccttcttgaactgatctttggtcacatcttttacacgccacagggtaggcttccagtcagcatcgcggatcaggtacttcttgatgtcgtcctggttcgagatcttcatcgggaccatcaggtcaggcatcttaccattccgcaaatcctctttggccttctccatcaggtcaggtggcagaggcaccagggtattctctttattcctttgttcccggataaaatccccgaagtgcatagggtcttcaacaccgttctggatgcagtatctttcccctgccgcactgacctcaccattacttttgaaagcggtttttggtggacccttaaactccagcgcctcgcggttaaccggatacccaagcttgtactgtaaccagttccatccgtggtgggagatattaccagcaccatcaaacgggttagctgggaacttaggttgttgagattttgtcatctccttcataggaagtaacggttcaacctcttcttcgatctctttcatcataacatcaatgcgatctcgaagtttttccgcctcatgcttgttgaacggaacaccctgaatctcttgctcaatcatcaggtaatccgtcagcatacggcgacgaagagcgtttttccagttaatctggcgaataccttcgggtttatccgtgtacatgaactgcttgtcatcgggccaacgagcaccagtggattcatcaatcaatgctttccacgtcagttcgttgatcagaacgtcttcccacacacggttaacgtactcccagagcggctggttacgccagtcatcaatctgaactttcttgttcgccacacgatagccccaagccataaggccatgtggaccaacacggtcacgtttcccggttaccgggttcaaaactgaatcaggacagccatttggtagtggtcggtcaggataaagtacacggctcatagacagagtatcgtacaggttgacttgggtatccccaatcgtccccagacacttagggtctttgaacatgtcgtactcaatgcctgacagtttcttccagaggcgtagatcataaccaaaaaggttgtgacacgcaataccacggcaagttttcaggaacgcctcaagctcgtcatatgagcggatcgtgagattggcttctgtcttgctgcgagcatatgttacggcgctctcatactctgggtgtgcaggatctaaaaacagattccagttgttaacaccgtattccttcagaagggtacagtggtacttagttacttcctctaacagaccatcagcttcgttgtccgttataaacaaacctttcatgctcctcctatgcaaggtgggttggtctgtatcgacacccacctctcagttggttaatatatcatcaaaacggcgtatcctcatccatgtctgctggcgatgggagttgcaccggattctccacgacaggtgctggtacattgaccttacccaccggagtctccagttgtagggtctgaaccataccttcagggcgaagcatgacttccccgtccagcttgaacatcccatcttcccatacccaaccagatgcatcggtgaattgaccgttttcatccatgatcatagtgtctgcgacaccaagttttttgtgtgggcggttcttcatcacaaccacacgcacacgtccacgagagcggtctggtagttcttctggttcaacccccaatacaatccaggaaagctgttccagtgcagcagaaccacgcaggtcttctttacgtacaggataccagaaaggcaacatattaccgtctttatccttcggtaactgaagctccttacgcttcatgtggctaatactgagaatgaacacatcatactgcttacagaatgccgcaagctcggtcatgatattatccaaatctcggcgttcattgtctgacttaagaccggagatcaccatcgacaggtggtcaaggataatccacttacaaccatcaaggaacaccatctgtttcagcttctgaatcaactgatcagtcgggatagaaccgaagtggtcaaagatcttaatcttgtcctcagcaatccaccgttggtgaatggcaaggtgctcttcctcagtcaggaactgctcaggatctgcaacaaatgctttcgggtcaactttcaactcttcagcatacaggctgtttacagactcttcttcatcctcttccaggcgaatgattgccactttctcgttctcagtccacccgtcaagacgaggaatatccatattgcgaagataatccacgatggcgtactcaatcttgcgagaaattgtacttttccttatgttcagcaaggttcgttattccttgcccgacccctatctcgtatcggggtctgctgcatgtttccatgcagagcagactatatcatcatcctttcaggatgccttgcgcttccacccacttggatgtacaccgttacactcatcacggctagtcgttacacgttccgaaaagtctctcttgatgtttaatacagtcgttttagaaacaccaaacatcttggcaacctctctgctggggaagccatacttcaacaggtcgtatatctgttgccgctctcccgaaagcagggttagttttggtcttcctgaaaagaattcgtattcagaggttaaccattcccaagtttctctgtatttaattctttttacaatccgaaaaggaacggaaaatcttctcgccacttctgatactggaagttcaagttgcaaagtttctgctatctgaagaacttcactctctgtgactttagatgtccatatttcctccccacgaggacacaagcttgttaaaacagcatggtcttgattttcccgttgggttacccattcaagattgtcaactgagttatccgttttatcaccgtttttgtgattcacataaggtttaccctctatgggttccaaaaatgcaaaagctacaagacggtgaaccatccaccgagtaactatcccttctcggcacaggctaacacggtagtatctgccactggtatcaggttttataatcgagcctctcttccctcttacttcacctttgtcagaaacttcgtatccatcaaaattttctatacttttccacataatccctccttataaaaggagagactcttcggcttcgctcggtattgccctcgtcttcacgttagggttttcaccgaattcacaaggttttcttcatacattactgcatgaaggggctagtttgtcaacccccgccacttggtccagtcagtgtccaaagctctccagtacgtgggccttttgtcaactcataaagtcgaggcatacccggtaatggaacaccatctttcttcttcttacgaaggttctcaatggtgatattgctcagactgatcagtttgtcagggacatacctgtcttctgccttggaaaacatgttccagatttcacgacccttcccagcatcgtacatatctcgaatatctttaacaccagccggatcgttacgttcattagggtaacgagctacaaagatattgtctgacagcaagaatgctgcaacatcatctgtcgcttccttacctttcttgattttacgttccttttccagcgctgttgcttcatcgttatcaaaaccaagaactactttttcgtaaccacggataaacttctcattgttagcgaaggtgtcaactgcgttagctgtgccacagtttaatccgacaaaaggcagtgtcggaatacctgcaacttcctcaccgttctgaatggcagtgatacctttcagaacacttgccgcccaatccttcacccctttcggggcattggggcttgcagctaaagctttgacaaaatcaaaacccgcctgccacccagcagtcacatcaccttcaccctcaacaacaaaaatctgtttacgaccagcgcccatagcagcttcatgctgaccaaagaactgagatgctgcctttacagtgccgaccacagagaagtgtcccttcttctcttttggtagtgtccagtcacgtttcttataaccagtaagcttaccgtacttatcataatatggcaagtaggttgctgtaatggttacaccgtcgcttgctgaaacagcagaccggattttaaaatacttcgctgcatcaagcgagagactcatttcaggaactgccagaatacgggtgccattgactacagattccagggtctcttcttcgcgctgctgataactcactcttcctccacgattgccgttattgccaaatctttgtgctttcgggttttcctgtccaccttgtcgataagccgaaaaatcaaaattactcataatcctccatagcaatactctttttcccacaactctctttgctgagaggcttcattaaaactctcaaaatttttaaggagaacttttccgtctacggttatccttgccctccaaggctttgatggataacctctatcccaagaaacccctcttcttgcagaagacttgttggaagaattaggcatgttaccaccacctttacgagtatttgtacctcttgtaaggagttgtaaattagttattcggtcatcggcaacaccgcctgtctcccttaacgatttgatatggtcaacctgcaatccttttgggattggtccgtggtgaagcagccacacgataacatgcctataacacctgtacccttgaaagcgtatagtgcaatatccctttccagatattgatccagcttccttgccaataactgccgctggatgattgtggtttctacctgagaaggtgtttactttccagtacagctttccgtctcggtactccacaatgctgccccaatccggaccattccccatcatctctccttaaaacggcctaacaacaacagcaatataaagtccatcctggaaggaaataccaccttggatgtgataccccttctcaaaaaagaaattcaaattatcctccaacttttgtagggttgaagcttttgcgatcaccacatttttcaacttacctcctaatccatatcaaaaggtgctgtaggtacagtgaatgaagtacctgaatacctcgcaacacccgaaattcgaaactgatccatgaaacacttcgctgatccctcaccacccatcacccttgcaaatgatgaagctgtactccagccgccagcagatgcttgcgatacaatgcggtttccgttcacatagaactggagatttgtcccatcgtaaacaatcgcgatgtggttccactggttcgtcggtatgcgtgacagtggaccaacctgtacagaagcagagttatcctgcaaataaatagttgactgataggtttttaaacaggaagaagttcctgtgttaaagtacatccaccaggttgcactatcgactgccgtgttgtacgaccaaaactcaatcgtgaatggatcaccttttgcaaatgcaagatcaggttttactgttccagacatttgaaaaccaccattgcggcagtcaaacgaatattgaccaaacttagcctgcactgtactttgtccagcaggggtcccgtaacttgtgaatgctcgcgacgggtttgcttgatctatggggtagatgccactcactttgtcagcctgtagcagcatacgtgtatctccatctgatggccctgctcgaccaccaactaataataactctttcacttagcctcacttactggttggaataaaaaaccgcagcagcaaaaccacggggtgttaaagaacgtatcagttttgttttggcagactttcctcccagctttttatgctgttctgagtaacccttcgctaccgcaacgggctttgcgggtggcattttaaaaccattacccgtccaaagacacgtctttttagggtatgagtctcgcggattaatatactcagggaagaacggatgaacatcatcatggggtagataacccccatattcatacggatggaacatgtggttcggtctcctccatttggaggacagaacactcacagggttctctatcatgtatggacacccgtacttatctcctaacattgctgcaaccttagctgtattcacggctttgacctgaaaaagagggtctttggctgcttttgaggcaaaatgagcagcaccgctaactgccatatcggtacatggcggaaatgcaaagataatatctggcttaggaatcccatctttctctggatcaaaaccctcatcgatccaagaattgacatactgaatattaggatgcttaacccttaccaactcataaccaccatgatccccagcatcaaagttgaagcagtacaccttataaccatttttagcatactcccaccccatgatgccggagccatcgaaaaggctccacaccactttattcatacggacctcaatgaacaactcgctctgctgcaccattgaccacctggaactggtgagcaggtgtaaggccgccatcagtattaaggacaacgtttagtgaattatcggattttaccattgtaaaattcatccaaccttcggcttcgtgctgccccatgaggacaaaaccttcatcaataagacctgccagaatttcttcagcctcttctttcttggtctgcttcatattgaattcaaccagtttaacttcactttttgccattagaattcctcctcacgatggaaacaaccttcgatctctgcattacgcagatgttcacgtaggtgatggtacatgacatcatctggaatgtcaacgaggatctgggtgccgtttttgaatacagcataatgttctaagtcctgaaaaccattgtaatcccaatcgctctctttgctgtaaaagtccggcttctgaacagtataaagtgcttctactgcaaccacaccttcggttgggtgcttgtactcaaattcaatctcgactttacgggacttactcatcttctgcaccttcgtagcgggttagggttagctgggaaatacccagtgcaatacaagtcacagactcaaccacaaaagtcatgtggtaatcaacctctccctgcatagaggattgttcaagattgacaacaataaagtcgccaacccccggtgcctgttgatcaatagcaaggaaaaccattgcctctgcatactccccatcatcaatcatgcgaagagtaatatcatgccctgcttcacgttttgtgaaatcgaacacattaacttcacgatgaggttcttccttcttggcaaacagccagttaaatagttttttcagcatttttacgcaactccagttcgtctttaattgaccacaaatgcaacaaggcttttgtcatgtgacgatgcgcctcgttataattatcattagccacatctcgaagtttcaacagtttttctgttgaaactttcttcagatcagaaaaatcttcaacttcaaatgtcataaaatttcacccataatttttgagatttaatacctgaaccacctgcatagcgggatttatcacgctgtacagacacctgctccacaatacggttttgaagagcgaagcttaaacgatcaggaatctttctgaaagggttaccacggaacattgcattattgtggtatgacaccgcatcttccagggagataaaatcattaccagaaagggactggtaaccaaaacgaccatctgtaatgttcggatattgtggaacacgacgaggaacgtagccgtatgctgacatcatctcatcaagagaggccatttggatatgtgtagtatccttcggtggcttcaacgcacttgcggctggggcgttgttccaatcttcaagttccttttggaacttcttgactaactcatttcgagagtatgatgccataattttatctcctatttacctgggaaagtctcttcataaaatcttactatacgttggtcaacaataatatccttttctttgacctttttcaatagtcttaatcctttagctgatgtagccctgctgaaagcaacataagccataccgggtgcaaaagcgccataaccaaagtctatattaagttcaggtaaagtcaagccctgcgctttatgaattgtgacagcccagcccaaacggatagggagagcacggtattcaccgatagtgatcttctcaatctcttcggttgttgtaccatcagaattcctgaccttgattgggttatattccacattctcccacacataggcatctacatcaactactttcccacagtccaaacgaaccttcacactatccttaccgagttcgattatctctccacgggaaccattgacatactctggctcatcaaagcctttagggtcgtttactgtaatcattacctgtgctccttccttcaggtaaagctcttcaggaacaggtttttgagtaaactcaccagatttcttcgcagtgtacaacgtaggcaacccagggacctcatcaaaacgcttcttgtttactttatccgcagcagcatttgtagatgtgatcgttatggcatcaagaggcttgccatgatcataacaatgcgtgttcatgaatttaacaatttctggaatccgctgtccacgacgcagacaattaagcatcgttgagaaatggacactgctctggcgataaactttttcaagtagtattggataaggattgagttccttccaagtatctgagaaacaagccaattctgtgtaatggaactggaaatacgtctccttttctgtctcggtaaggacgggcgggttctggaagaagtcaccaaacatgcagatctgcaaaccaccaaacggcttatttggttgctttcttgcgagtcggcatttcatatccatttcccacaacttatcagccctgaacatactgatctcatcaatgatgatgatctttagcgctttactcttcaatagccgtttcactttcggcttaatctcttcagtatcctttttggtagcaacccccattgtaagcccaaacgcacggtgtgcagtcatcccattgacgttaatggcagcagcccccgtaggggctactgtgaggactgaacctgcgtagagcgattggatggtctttatggtgtaacttttgccgctaccaccgggtcccgtaacgaatacgttatcccccgacatgacagcaccaagggcagcttcaacgcccacaccaaaatctgacatcaatcctccttagtttcttcttccaggtaaatctcttccagaatttcccccatcgtcccgataaccagcacatccggcgcaccaacgggtttttctgcacctgtcaggacttcataacggcagcaacgacacttctgttggttgtagtcgtaaggtacactgaccacatcagcagggttaaccgcaacctcaatcagtccgttgccaccgaacccaccagcatactctagagaggcgatatgcagaccctggctacaagtttggttagggttatcttccaccatgtttcgaggcatggaaatgatttgccctttatagttaggaacctttcttgtgtagctatcgcgaggtccatcggttgtgatggtgatctttttatatgccttcacatcaccgttctcaagaatctcaagatcgttgtgctgaataaagtcatacagcattttcacagacgcataagacgggttgtgcatcagcttctgcatgaacttaacataacggtcatcgaacgtatcattcttaatgtcgttaagaatgcgatcagccagggtgctttcctgtttctgaccgtgccagtacagaacgccatccagcaatttaaggtcagggccgagatcgacaaccttttcagccttggcttctttacctgcttcgatcagcgcgatagccccttcgatatcaccctcaatcagcagtagacccacatcagggaagatatcgttgtcacggttgatggtgtgctgagtaccatcaggcatcgagatgcaaacattgccgggagtcatgatgaccacagggtctttcttctcaacagtctcttcgtcgaagtacgtcttcggctcggactcttcaacaaccacagtcacaggaaccttgtgtggttcaggcaacagggttacagtggcctcgatatgcagatcggtaacgtcaaagacgacttcccagcgcttcccctgcttaccgaggtctttaaccacaccctcgtgtttatcacgaccatcggatgttttcgcatgatcaatgatcttcgcattctttttcccttttgcaaaatcacgggcatcaccacggcttgcgaagaactgtgaagcctgagcaggcttggcttccgaggtgaaactcatatctacctctgggggcttagatgccccttggctgtcttttggtacaaccatccagcgcccggttgcgagtacagccggagacaaaccacggtccacgaccttcatgccgttgtctgctgcaaacttacgcgctgcgctacgggatacgaataactgactcatttagtttctcctttgctatcaataagttgtcgatactcaatcatctctggtgtgttgaagtgcttcaggtcaacatacttgagcagcgggtatcgagattttttaacttccaaaagctttttaccaatacgcatacgtgcattgacaatcctttcagcctttttctccagagcgtaatatcccttgatgttcgaaagcgaataagacatgttcactttaggcttatactcagggtcggtttcaactttaaccccaaaaataccaagctccttcaccaactggcgataagttgatgagcaattggttcgctggttcagatgatactccatgagattctgttttgcaagctcataaaggtcatctttggtaacgatccttgtttcatcaggtaaccagccactgcgattaagaggcacaatatacatcttgccctcgacccccaagtccttcaggaaagtctctggctgttgtttacggtgcagatactgaacagcaccaagatcacaattacccttcacctgtccaccactgtagatcatggcggcttcgatatcatcaaagtcggcgcgagaaatacggtcgctcttgatagaaccatcttggtcgataacccacactttgtgaccaggttcgtacaagccataaccaccgtacttcttctcacccttcacgacaggacgcttctcaaggtcggaaagtttatgcaccattccaacgaagaacgggtctttcaggatctccagcgcctcaatacgttccgtaacgtagacacgtttgaagcagttctcagacagccagttacatttggtgcggatgcacttaccgtcatcgttgtaaaccagtggcgaaccgttcataaggtcagcataaccgtaagtcttgtcagtttcacggcgagtacccttctcaccataagttatgcacttgtcaatactgaaagtcccaaagtggtcatggaacttgtctgcgataaaccccgacccgtaacgggttgagaagtagccaccgacacgcttcatatactccagcacttctttcagtgtaggtagctgcttaagctcttccacgacttcctgaccacgtttttcaatagcctcagtaacaaacttttcgaggcgatcacggaaaccacggtcattcttaccttcgatggtccattcacgaccagggttcacatcacaatccccgataggaatagaaaccatcatcataggccagttcttattactggacagatagttcgacagataaggttgctggcccatcacaaccacgctgtctgcattgcgggatacggaaccgtacatttccagcatccaacctgtttctttgtcctcataacgatactgaaccgggtaggttcggtcattgatctcagaggtcacaaacggatcattgatctcatacgggaattttgcataccgcaggcacttcacgattgcctggcgatatttggaagtctcagaaggatctacgttgaatttgatttcaacgccattttcctctgtagtcttcgactcgtgcagaggaacaacctctggaataccctcattcttatgcaccgagtaaacagttttcataccgtttttgacggaggtgaccgtaaacatgtcggtcacggtgaacggagccttagagccgatgcctttggccccaatcaattcattggagtcacgcttagtggaggtccccaacatcatgaaggtctgtgtaaccatgtcgaagtccatacctaaaccaccatcccggacggagtaccaaggctccaggtcggttggggagtggatgataatcggcttatcacggcaaccagcttccgtgtgtgagtcaacagcgttgaacagcggttcacgcaccgccgccagaactttgtcgttataaataccgtcgataagaatactgaaagtctcagcattaatcgcgatcccagcctgatagcgctgtacactaccggatacttggaccttctcttcggcacgttggattatcatccttctctcctctatttgcagttatttatggggtttcttttgcgagctttccgcactatgtagatgcctgccagtaatccaagaagatacgctcctgacacttgttcccagaacatccattgagtaatagacagtatcacaagatacgggataatgcaaacacaaagcagcaaaaaaattcttcataagttcaggctccctgggggtccggcttttctttgtagtagatgtggttatcaatactgaccgtgcgaatcatcgccttggtccagtaaggcttaaccttctttgaatgataatacgtagatcccttggtgatgtcaatggcatcataaacaattttgttattgttgtggatcttggtcaatacctctgcgaactccttggccttttcccaacgatctttctcatacactttgaagcttgtactgtaggatgtccaggaaaactgccccggttggtagacaatcttcttcaccgtccgaggaaacttatcattgtcttttcggttaagcgtcacaaaagctattgacataagaccatgatcgctttcaccacgggcttcacgatacatattacatgccaagatgtttaccgctgtatcatcttttttacaaagatgaatcaccttgggcttctttgcgttttctttggctaagactggtgtggtagtcagagaaaatgcacaggcggttgccaggattattgcttttattttcaaatcttgctccaaattaaaaagccccaagaaaggggctatcaattaacggcgggagatgtcgcctgagacagttttcacattaccttcgatcttttctgcataaacatccccggacactgtggtaacgtcccccagtgcgccgtgctcaacatgaacatcaccagaagttgtcttgatattgccagcatttacgccgtaaacattgacatcaccagcaacagtggaaatacccttggtgtcaccatgaataaccacagtgatgttcttctcttgcgtggtgtgaactaactcgccgttgatgtaaatgttatcaccacgggaagtaatgttcatatcaccaccaacaacgttaccattgatgatggtattgccattgatacttatagagtttaccacgttatcctccatttgtcttctcttcacatttaaccactcacgcagtcccatttacagcctccagatcttcctctgggtacaaatacatacccacagaatcgaaagagtatacccaaccactaaagtaacagcgactagttatgcttagtatcctgccgctaagaagatcctttactttctgtcccacctcaaacttgggtttcggtttttccattcttcacaatcctcgctttttgaactgagaagacaaaggtagcatgttcttccacatattgtctaccctgttcttcatcctcgaagattaaagtttcacactgcgccttcaaaggcttgtctttaaccgcacgggttgtggatacgataagggccattacagcccctcgttcagtttttgcatgtaccaaccacgagatttgttgctgataaatttggcaacatccttcatggttagggcattcgcttccagaacatcaccttcttccttgttgatgtcacggctaacccaaccgatgaactcaccgatcttggtctggtcgagacccacttcacccagaccctgctccagacggttttcagtgaccgcatactcgacaaactcacggatattctgtaggcgtaccggatcaacttctgccagggtcttgaccttggagacagaatgtttctcgcctttcactttgaaccacagaccggaatcttgtgccagttcaatgctctttggagaccacacgatcccttcaccgacaccctcaacaccgaagaacttaccagcagggcattgagcttccacctgcaaggtcagcgttgtcagatcgttctgtaccatttccggttcgttgaacgggatatgcacgtaccagtaaccgaaatccagcacgttgaagatccgctgttccggcaggcccatgccgaagattgcgcttggtggcaaccatttcagtgaggtttctttctgaccgattgcaacacggaagatggcaaagaactgctcaacctcactgactgcgacacctttctgaataccgcgaccagcccattcaccagcgatttcaaccgggaactcgaacgggacttcgttgatttcgcagatgtgttttacctggtccagcagtgctccagtatctttacgcaccatgaacgccatgaagccgctgttatcctgctcaagagacagaacacgttctttggactgaaacacaacttcatcttcggagtaaaacacaatgctcccgttggtcccgtggatcttcacagtccccacgtatggcaggagaaactcagtcgggttaacaaccttgcgttttacgcagccgttttcatcaataccgtcaaaggtaagacggtcgtggacagaacggatcacctgacggaactggttagtgcttgggtatttgatagctttagtcaattatttctcctccacatacacttcgttaccgactttcagggtgcgcttcacagaatctgcttgggtgacaacccattcgccgggagataaacgttttgtggcctcctggaaatattctggggtcacacgataggtcagattagcctctacggacagaaccccttcttccggataagcatctttcgttgcatctgcaagcagcttaaggatgtcatcacgccacaccggaagcaaggaatgccagcaggcacacgttgtccagtcgataagcactgttcatcgtgatggcgtagatgtcacgctcatgaatgatcagttcttttacaacagaggttcggatatcgccattgtcgaagccgcgatttttcagatcacgataacaaaagcctttgatgcaccgaacatccttcgtgtcaccaaagccgtaaaaaggacgggcattggtaagtgcgccagcaaaacgcttaccaccaatgtataccgcttcctgttcggtctgaccgatacctgctacagatttactcattgtcatttctcttctcctcaattaaagacttaaccagcagttcgttaacacagactacaacataacgattctggttgtcaaattttattttcttgccaaggttccaggcgttttttgcagcgccggaacttatccaaccgatctttgctttatggtgccacaggcagtcatcctctttatcatagatgacgtaaacgctgtccttactcataaatcacccctgcggtggttaccttcgcgatcttaaatcggtcctgctgggagtacagacaacgcagcggattgtatcgacttgaaccaaaagcagacttcgctgttcccgcagaaggccatgatgtcttgtcgttagcagacttccagaaggttgcattgtgggtatcaatgataacgtaaatttcttccatcagtcatccccctcgtgtttccacccaagggattcaatccactcattagcctttacgagattgtcaacatcatctctaggatcttcatctgtcatcaagatgagtgcatatttttttgccacgaggagcactgtatgtaaatacagttccatctgttgcatatacatccacacttttagcatggaccttcattccaggaaatagttcaatcatttccagtctccgttgataattcgcagcaccacaagattagtgaagtacacaggccagagcaagcccatgcatatagcagcaaagagatctacactatcgactctcccgaaatctctctgcgtcctcttaatgaagatgtagaatccaatgaatgctatcaaaagatagataatttccaccatcattttttctccggtaaaatatacaccgttacatcacaatcgtggaagattgatttgatcattgcttcgatgacattccagtcaccccctgcaagcccagcacctagtttagggaacccgattcgatagatgtccatagggccgtctgtatagctctgtaagagctttttcatttcaaccatcgaatcgtacagggcattgtaatcgaggtccctgagaccctgtttacgacgattatagccgtattgtgagtaaagattaaatcctgcgagagacccatcattcaaaaaggccactgtacaggttcccagcttggtcttgtcgcccttctcagttttcaggtcggcagcgtacatttttgggaacgcctctttgattagaggagcgatcccgcttcccatcgtgcaataacaattgcagccatgcgcgaatacattgacctccccagatttcacagcctcaatcaggtcacctactttatacttaagcatcagtcctccactacaatgtcatgaatcgtttttacgtatgcttgataacattcactggcttcctccgcagagtcgaatgttccaaggtgggttttgctatacacggcatggtatctgagtcttgtccaccttttatctacgaatacaccacggaaacctgtttggttctttttacccctgctataattataaacgtttacaaatttctggacatctctcaggtttgtaatgcggttgttatctttttgtcgatccttgtggtcaataaagtaagtgggccataccccgtaataaaaagcccaagcaaccctgtgtgccaagaagtaaaaacctttaccttcaattttaacaccaagccttacgtaaccgtcttttctttttgtcccagcaacctttccaaaatgacgacgagcgagagggtttatacacgtaaacaaacctgtctcagggtcatatgagaaggaagatttaagcgcctgcaatgcctcttcactctccttcatgttatttcttcacctcatcacactcgtatgggtaaacgtcaaggtcaccacctttccattcacaacgataatattcaatgaaagtcccgttataaacctcttccaaaacatcgaggacatctccagcacggggatggtctaagcggtcgctgtagttgcagttcatttttactttcatgcacaactcctctctttaaaagcgtccatgctttcacgagcttcagccttcgtcttagcacagacaacaaaaatacgctgacgctggtatgtgtaaccagccatcaccatgtcaaagcgatcaatccaccaaacctcgttgatctctttcagcggaaatttgaactttgccattagcgattgtaccacgctacgtgggtcgcccattcaggacgtggactccagcaactgatgtcggactcataattttcatcaggacaccagtacccatttccatcatcaggaatgaaggcaccgcattttacacagcaatcccatgaatgtacatccatcacatcggcataattaggaattggacgaagtttctcttttaccatagttcccccttcatgagaacaattctgttccgttgtgcgaaatccctgacaaagtgaacatattctttgtcgtgctccgctatcttggctaatatagccccagcactctctccagccatccaggaagattgacaaaaaccattgtcttcacggatgtggcagttctttgcgtctgggccgtactgatccttcacatattctatgtcaagagagcctaaacgaacaaaacgttcatcaccatctttatcaaggatataaatatacccgaagctaggtctacgcatcaatcacgctccatccctcatcctgccatgcctcgccaagataccaaccagccatgttgtatcccatttcgcacacgatttgcccgttcttcatctcgaagaactcctctggagtaaagtattggttgcgtacctttttaccttcacgcatagcctgctgtgcttctttccagtttaacttagtcattgagtttgtcctcgcttttgtttgtgtgagcaaagaataacagccccacttggggctgtcaacgattaatttacgattgcatcaacaccttcagcaaaattcttgcggtattctgtgatgatctgcattactaccgggtatttacccaacaatttggcaggtaagcgctcacgatcacccgacaacaggattgcttttccaaaagagttctcttggatgaaggacataaacacagaactcacgaaatcacggttcgatgacgtatcatgctgaccaaaattgtcatacatgtactgcaagaagttcgcagcaaagtcaataacctgatcatctgtgtactctttgttctgaattgccttacgcaaccagattgaaccctgagagccgagggtccataacacatctgaggtgtctgacccggtgtgcttcttgatcgatccgtccataaccccctcgataggaaccatatttgcaatacgggtgtgataataccacaactcatcggtcaatgctttgccgatagatccttgtagagcggctcgtgccaggcgggtggacaagatacctgcatcataatcgtacaggatatcacttgcggtaacccaagtacgaggtgtggcgtatgaaggggagttgatttccaacatctcctcatagttttccagtttacctgggtttgcaccgataaacgcaacaacgttgtggtgaacatcgttgtgcagggcataatcttgcagccaaacagtcgtgtcgtaatcgagttcaaccaggatcatacggttagccagaggtgcttccagcatacttaccgcagtaccatcgccgggacggttgcctgcacctgcaaacaccgctcctttcgggaacatgtaggtgccaatacggtgatccagcatgatctggtatgcaaccttctgaaggtaaggctccgcatgaagaagctcatccaggaacacgatacctttccagttaggatcttcaggccagaagttagggatcgcataaacggtccgggtaacacccttgtcgtctgtgaccgggatctgtacgcccacaacatctgacggctctttatccgcaagacggaaatcgatcaggttgtcgtcacgttcgccaaacagcatgtttgcgacctgcttcattgcctgacttttccctaggccagcaccaccgaacatcatcagcgagcgcccacggcgctgacagaagcgcattaaatccgggatgtcacgtagggtgatccggttatcatcaaaaatattacgactcgacattcgtttgtctcctttcttcaagataatttgcaattactccctcaatttcttcaggggcaatatcattgtatagggtatgaatcctcgttgcaagatcctcagagaacattttttcatctggctcaagcttttgagcaccaaagactgcataccatgcacgacgagtcaagcggtgacgaggaagcggcatgactgccgcatctgaaaaatctaaagctctcacttatccacccacacagaactactatcacaccaatcataaaacaggtccatcgcctcgttgaactgcgccatcggggtatctttggatatttcacagatctcatcatcgcaaacattttcgtttgcaatgagacgggccagcatgtcacggtgctctttaagagtcggtactgattcgaacatgtcttgaacctctgtcaaacgagggtcccagtcgtgtccatcaatcatgtgttgtggaaacttacgttttattcgacgtgcgatctcttttgcaagttcatgaacagtcttatctgtccactcttctggaccgcactcaccattacgttgaccccacacatcacgcaaatcaaaccgggttctccagttacgcattgttcttctccttcttagtgataatgaatgtatcatcagagttgatccacatcccgtctttttctactgcaagcaggcgtttaccaaacagattaccaacagcaaccccctcccatttccggggcatttcttcgtcaggaagaataacctccacatgaaatttgcctggcaggtgtttgatattgtgctgtaacaaactgtttttgctagggtctttaacccatgccttcaacttaccatcataaacgtaacgcgtgtttttatgatacaagtaatttccccaacatgttctgatgatgttgtcaaccgtgacttttacccgacgaccactttcaaactgtgcctgaatcaaagctgatttcagttcagaggcacgatttttatagtaggtaaggtgttcttctttgcgatcagagcgcttcaagaggtagtccacaatctccgcatcgctctgccctttactacgccttaactcgatagcctcttgtaaagatttgttcatatcaaagctccttaatggattcaaggtcaaggtagtcatcaccacccaccactttcccgtcagttttacgatacttcacggcttttcctgtctctgaatgctggtaagacatccagtaacgagatgtttcgcgaagtttctcagtccacgcccagccgaggcggggttttttgactgtgcctttgtgggtgtagccttgatttctggacattctttgctcctgtatagagtcactttgtaaagattttgatcgtaaacacaaaagggtcttgacaccggcccgctcaatttgtatctgcgacttacctgaatgtaaccacgtttctccaacttgagaacgagcttactcactctccacgagggcatccccagcaggaagcccatctgtttctgagtatacttgtttgtgcgaagcagtgtcaagagattcataattgtgacaacaggttaattgcttcatgatgttctttcatctttgtcagacgaagatacatgccgtggtatttacggacacgcaacaaatccttatctgtaagacctttcaggcgacgaacatcagagttatggcgtaggtctgcaagtttcacacgaacagcatcatagttgcttgcaatgccctggaaatattcctccggtgtttgattgggggtctttgtcagaagaaccacagcatcttccacacggttggagaagcccagaatgaccagatcagcagccgttacatcggtatcttccaacacatcgtgcaggacagcaatcgccatgagttgaaaatcatcagtcttcaggtagtgcattaccttcaggggatgaaggatataaggattaccgcccttgtctttctgattcaggtggccctctgctgcgatcttgatagccagagcaagttcttgcgccggggttaaaactggaatcgtggaattgaaagttcgtaccatctttgttgctccatcatattaaaaggtttgatcttgagtgtatcaaaaccatcaatgttgtcaagccagaactcatctttatatccagccatttccatcatcattaactcttccgggctgggtgtttcccctgccatcatatttttgagtctttcatcccaacggaaggtgaataatgtctcattcttattgcaaatcaacaacgcttcacgggcattcttgatcttaacgccgcgatcacgcaagtggaagacgctgtgaccaatgtggttgcactgcacatcgaagttatccctgtccttgaagtcgcaaaatacaagaagatctccgatagacaaggagatcccaagaatatcaatatcgtttcttgacctctgcgtgaattttgaaccaaagccgtatctgcggaactctgcattgattaaaaggtctggttcacaacgccccatttgtctgatcaggggcttcaacaaactgagaaactcccttgtacgacttgaaaacctccaagcagaactctttgtaaaggcatccccatccccatgcccccggataatggcagagacattccctcttgagacctcttcccgctcgaacgggcttgagttaaaggccctgtctctgacatctacctccagacgggccaaaaacctcttatccaggctctcccgccgataaccatcccagtcataaccccagaaccaagaaaatggtccttctctcctatccaccctttcaagcaggcccttgagtagttcagccaggggattgtcttccatcacccttgggttcaaccctgaaagaaaatcatcggtattcattcttggcgtatcccagacacccatcattgccatttgacggtactcgtgctctttttgccagtgctcgatcagggcgcgagtggtctggtcatcttttaataagctccagtcgatatctgctgtaaccttgggggcatttacttgtctaacatcaacgttgaatttgttcatttttatccttccttcaaacaaaagtacacaaagcatacactgtaaagaatttgaaatcaagtgttgacagcgcggaatgaatgccagataattcaccccacaagaacgggaacaacccaggagtagaacatgattgactggaaaaaagaatttacacaaaacgagatgaaaaatctcgaagagcgttaccacacaaagattgagcgtacaagaaaacgtggtatcgagttctcactcaccctcgatgattggttcatgatgggtaagaagttactcggtatgggtacttgcgactacaccaacatgccgtttcatatgggaaccgtggcgggttataacccaaaatacccttcagttgaacgtatcgacgataaaaaaggttatgtgcgtggcaacgtctgtgttgtaatgcgtcgtgccaacgaattgaaagattgtttggttgacaagaagaccgcaatcactataattgaaccgcttgatcgcgagattgttcaggcaatgatgctgaacatgtcaaaagaccacatggaaatgctgaaaactaaatatatcccacaacaggagaacgagatgattgctatcgaagagaaactgagccaggaagcagaaaagcatatgcacaagggcgaagttactgaggaagtaaccaaggctgtggaagaggtcgtagaaaaagcaccggagccagcaaaactgccggatgacgtagcggtagctctggcgtatgcaaactactgcaaaaccttctctgatgtagggatgaatgtaagtgtgacatatgcacagttcaaggcaaaatatgtccgtaacacctgctcgatgacaggggagaagttgacaggtgaacccaagtcaatcctgatcctcgaccttaaacttggctttgcgaaagataatttcatcattgtatccaagaaaatggaaacagcaatgacccaattgatgatccagacaggtctcagtctgccgaagatcaccgcgatgctgaacaaggtggtataatgtacgaacacatcttgggccgaccagcaacggcccctgaacaaaagatgctggatcatggtttcaagcctgcgattgtagttggtgagggggttatgattatcgacgaagcccattctggaaaggtggatgcaattgtactgtttgctgttccaccaaccccgtatgagccaaggccaaaactggcatggggattcagggtggaaggaagagattatttcgttgaagaaaaagagttgatccgcattcaaaaatgacatatactgaggccatcttgattgatggccttttttatttggagagagatatgtataaagacgaaagcgaaatgattgaaaagcttcagaaagatgctctgaaggtcattcaatctgcacgtattgcattgttacaacagcgcccattttacgggactttgctgagttctttgccgatcatcgctgattggcgttggttaccgactgcggcgactgaccaccgcaacctgtattataaccctgagttcatcatgggtatgccggaagagcggaagaagaaggtgttttctcgaattgataaacacccccacatgactcaggaacagaaggatgactacaaagaatatatcaatgtattctatcgtaaaaagacaccaagggaagtggtggttattctcatccatgagacacgccatataaccaatgatcatatggctcgtggtaagttcttcgattcaaaactgtacaatattgctgcggatcagtatatcaacacagatattgtgataagcgatcttggaccacgttctcagggtatgcgatttttccctggtggggcgcaaacagtctttgataaaaataaagaattcggatttatggcatactgttactgtgatttctctttccacgggatgacggcggaagaaatttacagcgccattcacaaagggaaggctgtttcaggtcacccaatgggtactcatatcggggattatgacccagatcgtgacattcttgggtacactgatccacacccgtgtcaaggtccggtagcaaaagatgagaactttgcatggtcagcgggtcttattgaggctgcattaaaggctgcgggtggtgaaggaccaaaagaggcacgagaactggtagccagaatgcgtaaaccacatattgattacatgcagatcatcaaacaacgaatgatttctcgtgtgagatcgcatctttcgttccgtaaacctgctcgtagatcggggtctgttacgcaagtgttaagaaactacggtgctatcaccaacaagcaaagtatcatcttgccaggaaggaagcaacaggatacaatcgacatcgttatcggttttgatgtgtcaggttctatatctcagacgacactcaccaagatcttcaacgagattattggtttgtgtctgctttataaaacattccgtgtgacattattttgctggtcaacgaaggttggtgatgtgaaagtgtacacacaggagaacatcaaagagatgctggactacaatgtaacctccacaggcggtactatggcaggtgtggcattccagtacatcgaagataacattccgaaggcaacagatgtgataatcttcactgatgggtatattgaggatctcagtcatcggaaaaaagactggggtcgtaaatgggaaacactgtgggtcctttgcggtagaaaccgtgcgaagtttgatccacctttcggaagggcggtagatttagatgagcactcaaaataaaatcgtcgccgttggtctcggtgtggatgtggatttcatgtacaccggggcaattgtgcgaataatcttcaaaaaggatggttgtgagcattgtgagtacctcacaacttccaacaggagaaccttgagccttaagaagttcaagggaggagagtgggagaccattatcccaccagattacacggtaaatcctctggagatcaccacagaggaggagtttatggttagtattttacctggactttcaccatttgagaggtctttgtacactatggcgggtgtaattacccgcatgtggcataatgatgctgatgaagaatatgcgaagaagtatgttattgaattcttaagagattatctggagtggtgagaatgaaaatgttaaattcaaagcaaatgtgtatacctgatctcttgactcaggatgaaaaattgactggggatgatgttctttgctattgcaaggtaaaaagatgcttcgattctcggagagatattaaaaattaccctgtagaacttcttttcttagatactaagatggaatgggggttgttcagtcaatgcctgagaaatctggagagcagaggtttcttgcttttggatcgagaaaataaaacagttactatggcagattatgcttacttatatagccctggtggtaaaaataagtctttgtatattggcaggttttgtgatggtgtttgtaaagtaggtattacgcaaaaccctagtgaacgggaaaagcaactttctcaatatggtagtgttttcacaatggaatttgtgtatacttttgagaatgggggcctggcagggcatttagaaaggatgataaagtggcagattccaatgatggatttgaggatacctggtggcacagagtgctttgaaagcaagtattttgaaaaggctgtaggtattgtcgatggatttttatcatctgtctattgtggagaggttacagttgtccagaaagagcgagaggtgggtagcttgtgatgagaaggagttacatgacaagaatctgtcctgtacagatcttcgtgtcctgctgcatataaaatacaaagccggatacttagagacaaaatcaaagaaatatttcgcaagttacaagacgataagcgaggccactggtgtttctgaaaggtccatcagtacctctataaaaaacttggtcacacacggctacttatctgtggaaaggagaggcatgagcacatacgaatacaccgtgctgtgatgcaaaatttgcacctcgtgtcctgcaaaatttgcatatgaatacatatataaattaatacacataaggtctttaaaaactaaaaacaaaagatcttttataaaagacttgatttatgtttttgttagtgtatagttggtttcaagaggaagtgatggagcgatagcgaagcacttcagatgtgtgtggaagttcaatgtgaacggagccgattggcgacaggggcaaacttgtttacccgatctactccggggcggcgcggaggccgaaaaatggttaatattaaacgttctattcaacgtctggttccgaagtaccgtgtgatgaccagtagctcaagttgctcttgtcatgttgatgacagttgcgattgtatgccaagcctgtacttgactatggatggcctgacaggttacggcgctgcacactggacctacacagacgatagctgccctaaagcggtggactcgtggggaaaagcatactggtgttctttccttggtctggagccattctgggcgatgggtgaagacgatgcaggagaaactttgcgaaatcgtcttgacatggcaggccaacctgctaatatcaatggcatcaacaacaaacgtgctgaggcactgattgcggagcttaatgagaaatgaaaaaagtcttcataccacttttgttatccattcttttaacagggtgttatctgccagagaaaagggataacgccaaagaatatgactgggcgatagagttctgtggtggtaagacccagattgattccttcatggcttttgaggcactgtcctcaagcgttgattgtaaagatggtcgttcggcaattgtgccaaatttttataaataggagaataactgatgtcatggccttttctgatttacctcattgatgtactcactactgatggtacttacggcggttggggcttcctgctcttcatttcagcggttgcatatgttatcatgtatgcaattcagaagacttacgaagagacggatggtaagaaggaacggtttggattctttctggggcagaaccttgtcctgaatcaggactggtccaattataaagccggagatgtgttagttgtcaccaggattgataatgatggtacaatgatggtacgttatcctaatggtgatacttctggttggctgcgtttcgaagttttgggggaggtaacagcacctcgtcaacgtgaagcagagcgccaacctgtgcctaagcgcgacctgacaaaagggcctcgtaagattgctgtgttcggtatggtggtatgtttcctggggattgtatatgcaaacttcatgcctcagaaagaaacagcttacaaaatgctggcggcgtatgtcggtcagaatgtggtagaatcaccacgtactcagcaactggctgacagcaccatcaagtaccttgatgcgcagatcaagaagtacaccgaagaactggattctgctgcaaaagccgctgaagctgagaaggcaaaagagaaggagtctaaatgaccggaatcgctgaacgcgtactccagtcctcagtccgggcgcaagcccggtctactgtttctgtcatgatgaatctggtagaggaagttggagaactggcacgagcactgaatcgcccttatcgttgtgatgaacctgcaatcgcagagattgccgatgtgatcaactgtgcaatcgacctcgcttacatgcttgagcttcaggactgtataaaccctcgcgattctgatcggaaagagatcgcagaaaccgtccagcgtcgtcttgaacattatgttgacaagaagtgcaataagtgggacagtatcgtagagaagatgggggctgagtgaaatcatttgagaaaaagcgtatagcgcttgatttcgatgacacattcactcttgatccggaaaggtggtcgcagttcgtccacctcttctgttcaagagattcagactggtctgtcaagttcgtgacattccgattcgaaactgacaggaacgatgatatcaaatactgggctgaagaacttggaataggcatcatttactgcggcggagtgcaaaaggccgctgtctgtgcaaagctggggtggataccggatatctggatcgatgatttccctgtattgatccccatgaaacaacaactccagggtatgatccttgggatagagaaaaatgaggagaaattgaatggcgaagctcggaaagaggaaataccccgcgctgtataacaaagacaccggggcatggtatacagggtatgagaacgattacggtattgaacgaaaagtcgaaagatcagaacaacaccagatccgtcaccttgaaatccagtataccggattcagccgtgggcggtctgctgcaaacattgacattgttgacagcgatggcaacaagtatatcatgtcgatgtctggtttcgacttactaatgaaactggtcgatgcaccagcagccctactgcgtgaagaaaagttgaccaacttcgacatcatgcgtaagacaagcctagttgggggtggtgtttggtacacaggatctttctgtcagacgaagcagggccagaactacttcattgagcctgtggaggtgcgttgatgaagatcccttactacaccttcaagttctgggagaagatgtatgacctgagatacttcatgttcggaaacttaccaatcacctatgatgtaaagcataaaatgaacatggcatacatgaagtatcagatgagccagaagcacggtcagtaagatctgacaccacaatgccccgtaaagcacggggcttttccattggaggaatatgacgttaaaaagtgatgatgttaaaaggatactgcaagaaatatcaccggagttaactgtgattaaggttcatggtggcctgagaaagcttgtggatatttattatggtggtcttgtttttgaggactgtaggtggacacaccttaaagcaggtaggaagccgtataggaagaagaattaccccgctgctatctacagtttttgggatgcctctggtaactgcctgtatgtcgggaagacagtagacatcaatgctcgcctcaatcaacacaagaaggctggtttgattccagatattaacagggtgaaggtaatgtggttctctaaccttgcagacctccacatttgcgagccgtacctgataaatacattgcagccaaaacacaatcttgagtttaccacagaccataagacgagttttaaacttaatctcggtccttggcatgacttcacagactactggctcaatacccgcttttaacgcaaccagaacgcttctgcggggtttttaccatacagggtaggcgaacgtacagctatttattaaaacgcctcacaaagcgatacaggagcttttaagatgacaaccgttttccacaccacagagattctcgatcatacacagaacgaataccctcacccggatcttgaatccgagttactcaagatatttgagcgcacagagcacgagctatcttaccttgaattttcaactgatgaagatgatgaggcagagtttaacaaacgacacgggaatgtagagtctgagctttctgaactgaaggatatagcgaagggttcagagctttatgactataagaattatgtcacccaactggaagcgcttgtcgttactctcacagactccctgatctctgttggcaaacgggcagataccctgagtaaagatattttgtctgttgataacaagatgggtcgtgcagaaatctcggatgagtttttgtatctgtcgggagaagcggtaagggaatttaacacagactccagcctttacagcgctcttgagtctcgcggttggaataagtttcagcgtggttttgttttcaacatcattcaggaagagagaactggttacgcaggttctattgttgttgagcttatgctgcatgggagcactgcaaacaatatggttgttggtgttcaggactggatcactctttgcggtaagacactgtgtttatgtgacggtgatgataccttaagaatagatgctgtcaatgggagcattgatattatcttgacgaaggataaaaaggtctatcgcttcaggctctcagagatgaaggatcttttcatggacgtgatgaatccaactgatgatgaaatcctgatgtataaaatgtcgcaccatgcagagtatgatatttgtgggtggagagagactttcggaaagaaaccaaaatgaaaaccgtgtgatatttaggaggaaggtatgagtttagatttggaaatggaatcgaaaccatctacaaaacatcgtagtttagtatgtggtgttggcataaacgatgcaccgtttatcacgagtatgcggaaagatggaaaactccatcaccatacggcctacaaggattggcacaatatgataaacagatgctacagcggtaaatacccctcttatcatggggttgttgtggtcgataagtggcattattttatgaactttcatacatggtggtgcaacaattatcaacaaggatatgcacttgacaaagatttgctggtagaagggaacaaggcttacggccctgatacttgtatttacatccctgtgtggttgaacagttatatttctcgaaatggaaaacatgcaagaggtgtaacatttgacaaaaaactttgtaagttcaaggcacagagatctaaaaatgacccaaggggaaggtatataggatattttgacacagaggaagaggcacatgctgcatgggaatctgagaatatatttgataacgacctgaaatcacttgatatttctcttcaagaacttgttttgaaacggtacggtttttcaaaatgatatttgtttgcccttgatatttgtcggggaattttgaactggaaatcaaaatgaaattcgaaatggtttttgaaatggttttccctcatagccgggttgtaaatccattttattgtgatttaagattttggaaagtacagcaacttatcccaaaccccacccatgcaacataatgattactaatggaatttccatgccccggtacgataattgtggcaaaattccagaaatgttaaatcccttttgttgggttttaagtccgagtactcgatcaagttttcgatttcaaaatcgtattttttctttatcgctgaaaaaatttttctggataacactgggtactcgatcggtttttcaaaatcgaaaacgtattttttctgtctatcgaaaaaatttttccgcgcggttctcgatcgagttttcagttttgaaaacgtattttttctatagagcgaaaaaattttttagggatcggtaattttctcacacacgcacacgcgatgtcaagagaaattttttgttgaatgagaatcattctcatttgcagaatagcgggcaggttcggtgtttgtctcgcgattcccgttacccctcgccatgtgtaaataatagcataaccactccacggatcaagcgtctttacaaatctttacaaatgtcatcaggtcgaactaccggcgatccaccttccgacctggcacccgcgcccggtacgttagccccgccttttcgccgtggggtggcgtttcctcttctttgaactaactataacccagggccgcgccgattgcaagccccaggaccaaatattttttacagggtatccgctaaaacttccccgttttccgctaccactttcgcccggtagaatccgccgttaagcatacgcaaggcatgaggcaacggcaccgatctagactgacaatgatttgctgatgtttcccaggtgaaaagggtcaccattgtttcgcttgttactacgtttacgttttccattttctttacccgccgttgttgtctcagtccttatatagtacacgatccccgccaggatgcaacaagtataaaggaaaaacttttttaaaaatttttgtcctggggtattgacgggagttagtaagccgtttactatgtatcacatcagggcgacacaccgacgccccacactgaaaaggtaaagcaaatggacactatcgaaactttcaattattccgaaaacggcattgattttagcgttgacgttgtatgctttaatacaaatgatacatttggcgatgagtgggaattgaccgacgatcaccagggcggggtcactgtaaagaatcctaacgcggatcgcaatagttataaatatgctatcccgttacaatacagcctgaaagagcggatcgcagacttgatcgcccgtggtgatgataacccatcgcgccacgcttacgaggccgcacaggacgctttggagcgcgatttaaacgccagtgattatggtttcagtgtgaccgccaccgcgaacgggatcaccctcctggataatgagattattggttgtagttttacctattcataccaggacgaaagcgatttgttgaccgaagcaaaagaagtttacaacggcaacgggatcaacggtgaagcgctggacgctgcaaaaaaggcaggcgcggagatcatcgcaaactttgacggcctgaaaaatattttagaaaaagcttgatcaccaagtccggatcggttatcttactaacaagccggggacgcgccccggcactaacgagaggtaaacaaaatggaaacattattgattgacaatgacgggtctttgttggcggaagttacggcgattgacgcgcctttgtggtggcaacaaaaggggctaaccaaaacccgatccgggtatgggaccaagatccctacacaatggaaagttaatttccaggggcgtgatcgtcgggtatacgttgatcaatatagtaacgccggacacacttatataattgtgaaaggtcaaaaaataactgtaagataattgttgacgctggctaatgtgtggggttataatctccacacattgacaagcgaaacaaatcaaccacacaaacgaggttacaccatgaaaaactatttcaattctcgcgcccttgcccgtactgctgcaaaagccaacggcggaaaagtgatcgacaacggcaccgccgcgcctgctggtaaacgctggcaggttatccccggcgttatggtggaagcgatccaggacaccgccgatcaacgtgctgcaatggaaagcgccccggccctggttgttactctggaaattaaagcgggttaccgtaaccgccaggcggcgcgggtctcctatgtacacgacgcaaacggcaagccgatcccggtaacccataagcgatcccagatcgccgcacgtttagcggcgcatatggcccgataaaaaataatttgacaagcgccgggagactggcgcataatacccagaccaaaagaaagcaggtaaacgaaatggaaaacatgatcgagattttcaaaaaagcagtagaaaacaaaaccgcaattttaaattttcattctcttgactttacagatatgtacggtaatacatattttgtttatgagctttcgttcactaccccggagatcgacacctggccgacgctgtacaagtcgcgggatctgcgttatggttacggttcccacgctttacaagttgcaatgaaagatctttccactatgaccgggataaaatcagaatggggccacctggatcgctgggctagtgagaacggcttaaaaatcaacgtcacccaagaaacagacaagcgcaaaaaagatttaaaaaacttcatcgcatagcttgcaaaccatcggcggatcggttacattattaatcaaggcgggagaggttcccgccagactgaaaaggtaaagaaaatggcaaagtttaaaacatctatcaatctgtatgacgctgtaaaccgcctggcctcattgtcacgcacgaaccaaaccggggattttttcgttgttgttgattcctttgattttggtcgcgatgttaacggaaacacgatcaacaaataccgcgccacgcttcaccgtggggatctggtatccgtccaaaatggttacactggtttcggtgtgctggtcctggagtcgccccgtcgccgggaacaatcacacaacgaagggcaaagcgcagcgctttactggcttgaaaaaatcggttatgatctggcttatgaatcaatgaccgaagcgccccacactaaaaagcgcgcttatcgccatgtgtaccgggtaactaacaattatttaaaggcggtgtgaaatggtcgtaagcatggataacgggcaagttttaacgatctttaattctgcaaaccgcacaattgaggacgtaaagcaagaggcaagccaacggatcgacaatctaaagatccccggtaagctgttagatgatagcttgaaagtgatcgccgctttcgattctttcgggaaagaaatcattaaataattgttgactcttaataggtggggctttaagataagccctaccaagtaagagaaataacccggcaataatgccaaaccaaacaaaaggtaaattatcatgaataacaaaatcactttcaacgatcaagatgttgccgttttcaacttcctgaaagaaaaagggattgattttaaagcggtatatggtggcgttaacaacgatccagaatggcaagctgatttgtttttcgtgagtttcgaaaaaggcgggaagatttaccgctctgaatttaaaacgggaacgggtcaccgtgtaggccgtcacactggcttaaccccaaccgacgcaagagaattagctaaagttgatgctaaggtttccatcgttgatcaaaataactggacacgcgacgattacaagcgcaacgacaataaagcaatgtctttcggttaccgtgtttatgttgcgacaccttgcgccgcaaacgtgctttcctgcctgctgtcagatattgatctgggatctgaatctcatgctgatttttgcgctaatatgggctatgatgaggatagccgcaaaggtttagagatttatcttgcttgtcagaagacgggcgaggaactccgcaaagtgtttacaggtgaagacctggagacactccgcgagatgttagaggattattaaaagtgtttaaaatcctgtttttggtggctgctgctgctatctactggaagatccccgccaggttatggcggggcctgctgtgggtttattatgaatacaggatcggcaaagtgtaccattatttagaatacagattccacgggaaccactaccacacccggcgatctggtccgttaaatgatcttgagggtaacggcttattgtgtgaagtgaaaaagcggggcggagtagtcacgtatcacaaagaaggcacaaaggagcagatcgcggagatcatcgaatggcgagctaatgaattagccgagaaacaaggccggatctttgaacatgcaaacaacaaccgaaaataaaacgagggtttaaaatatgcgcaacattgaaaagatgacaagcaagcgtgatcgcctggcatatggggaagtaaacgagcgacgccagcgaaacgacaaactacacaagccggagcgcatcgccaaaacctggacgccggaccgctacgatccaaatcttaacaagcggttagccgaaagaaagcgcgctttacagtggcaagccgtacaagatgattaaacgaaaggccgggataattcccggctttttctatgcagaaaagtgaatttaaggagatctccgcgaggtgatgcacttgccagggtcaagcctggaagcgcttagaaagcgttttagagcgttttgcagggtatgacataaccccgccacgctcaaaggcccttaaatttagtaacgcagtgaaactatctgcataattgtcgctattcatgcaaaatcgctgcatatgagaacaattctcaacaaaaataatttaaaatagtgcttgcgtcctgctgtggttatgttatctttaatgcgtagggcggcaatggtgccaaccacacaaaccaaaggtaaataaaatgcaaaacgtaaaatctcagatcgcggcgcttgaatctcaattcctgggtaaaatggtttaccacaattacgggcaaatcggtttcggtgtggttactggcattgatgaccgtgatccgcttaaattacgtttgcgtgttaagtttacccgccacaatacccctgagcatatcaaaaaatatgacaaccgggcggatcgtgttcgttgcctcttgcctcaatcggtcacggtttcccgtgtacgttatgaggattacaaccgcacaaaccagatcaaaaaataacgcttgacacccgcgccgcttatgctatgattctacataggcggcaacggtgccaccacaaacgagggtaaacaaaatgttagattatactaattcttggtgtgtggtggcgcaggtatcttttttggtcgcaatgcttgccgttgttgctatctatatcattttagaggataattgatcatgttcggatttattgtaatggcttgtcacatttcccttacgaccatgaaattagagtgtaattggattgtaaaggaaacttttacagaagaaaaggcttgcaacgtgtacgaaaacagctataatcttctgaaaggcgagcaattcggcctttgtgatgagttgaaagatggcgctaaaaaaggcgacaaaacccaaattctttacctgaaaaaataaggttaatcaaatgtttgaagttttcgcgggtatctgtttttatggcgcatctatgatgatgcaatgtgatgattttgttattgaatcatacgatgatccgctatcttgcgagatcgccgctagtggtttacgccgtgatcctgattatatcaatccggcctgtattccttcgccagaagtggaaccaatgccataaaaacatttgacaacggcgatccgttgatcaataattaccagacaaggccgggagcggttcccggtcacctggtagaggtgaatcatgaaaggttacaaagtagaatacactacagaaaacccggtttacattgaggcgcgttttatgtgtcgcctggtgtggtctttcgtgatcttcctgctgttattatctttcatctaaaacgaggttttaaaaatggaacttgcaaataaattctttttcctggctggcgtttccgataatgcaaaatgtgattttcgtcgtttcgatgataaaaccttaatgcgtttttgccatgttaatgacgctgtgaacggggatcgcctggacattatgatccgcacggaaacaaccattgatcacgcatcacagcaggcagtaaaagatcattacgtgtcttatcagcttgaaggcgcgaaaggctacgtaaagcaggctgacagcttgccgatccgtcaatctgtggacgtgttcgccgtggttgttgcgattgtgaatgatgtttttccggttgactctgaaaaccagatcggctaaagtattcttaaaggccggggatcgcccccggtcataatgggaaggtaaagatttatgaaaaataaaaatgtttattggtcatcctcatgcggtcgcctttgtctcatctttcgggaccgtgagcaggtagaagagatcgcccactctggggactgtgaagcgtcaacggtggaggccctgccttatttccgggacggcttacagtttagcgcatacagcgaccaaatgatccgcgattacctggccgaaacagggatcgagcgtgaaggggtagacgggatcgacaatatggatcgccacaccctggaaatgtacctgctatggatcgccgctggtgatatgctggacattttcaacgttggcgatgattacggcgaggatgaataaaaaaaagcttgcaagccaggcgcggatcggttaatatctttttgaggccggggaatggttccccggcaagccggaaaggtaaacaaaaatgcaaaatttcatcactatcagcaataatgacaaactgcaatctttgatcggtatcttaaacgatgtttcgccgtttatcgttaaaaatctttatgcacatttgaaaaatgttaagcccgctatctggtctgcatattgccacgaccaggacgaaagcgcggcggcgtacatgctcgaaatgttaaaggatagtatgcaattttgtttatctcaaagcgttattaatgaagttgatagccgtttatctttggctatggaatatcaagcgcaagcggtgtataatcagttagacattgaagagcagcaagatcaagacttattctgggatcgtgctgatgctcaaagcgcctttgatgaccgtttagcaatgtatgctaacgaatactaaacaaaacaaggccggggacatccccggcataatctgaaaggtaaattaaaatgattaaaaatgcaactggtcaaactgaatttttacgcaaccttattgcaggtgaaaaatctgtgtggtattgtaaggatcaaaacgtcgatccggaaatgcggaaaatgaccgccaccgtttgcaaagcgaaattaggctttaagatccgccaatcaaaagccctgatagttaccccggattctatcccgcaagcgatcattattgtcgagcgcatatcatgaaaaaagttatttttgacaacaagaaaaacaccgttaccgctcaaaaggtcggggagtatatcgaactaacggatctgtatagtgacgcgccgatccgcctgtctcctgaagagtataaaaatagtgagcttgtcaagcatgttgtagctatggaatttgaatttttcgaatacctggccgattttgacgatgattttaatagtgatgggctttacggcgcataaccacacaaccaggacaaatgatcatgaaatatgaaataaccccggaagatatgaaagggcgcggcctggatagcgcacgatacacccttacaaagcgtgaaaatctgcaactgttttctatctgctttattcatccggacgatcctgattttcaatccgatcctgtagagttctgggctagtggctgggacaccgcctacagtgaattgatggacaatgtaaccacgtttgaatctttcggcctgtcaagttttagcgagacggatcgccccctggaatgtgagcaggtgagagcgtggatcaatcactacaacacccttgatcacctggtctttatcttcggggagacaaaagaagagatgattagaaaagcgcttgactttaacgatcattgtgcttatgtgcttcgcaaaatgtgcgaaatggtggacgcattgaggaaggcggaaagtttcgacggcggatcggtttacagtcaatcaatgcaccgttaccgataaggccaaaatctttacaaaaccagggcttgctttatggctgttttgtcaagtgttttttatggctggattgcctgccttgtactcagtgacgcaacggcccagacagttaacaccatgatcgacggcttgcaattggcgttttattgtgtggtgaaatatcacagatttaaacggttcgaccgttatgatctaccgttcatcattgccggatcactggctatcatgttgtaagtaaggccgggaattgtcccggcttttgcatatcacacaaacaccccaaacacaacaccaaatctttacccgcttttatgttggttgcaatatcgcaactgagaattattctcaccaaccccgttggcaattatgcaaaaaagtgaatttaaagagatcccaggaaaggaatataacggcaaggctaacgagaaaacacgctcaaaactcgttatattgcgtttaaaagggtattgcttatcgcctttgacccactaacaccccaaaattgataacgcatgttatcaactgaataaaacacgcatttttaagcgtttcatgtgaatacgtgataataactctcatttgataacttttctcatctaagccattgtgtgaactgtcttttttgagcataaaaataaaatcttgtcaaataaaataatcgttcgcgtgatcgtggtgagtggcgcgagcgtagcgagcgacactataacacgagagtaactcaaatgataatacttatcattttcgttcgcgttatcgtggctcgtagacgctacgatataatcacatacgtgattaagcaacggctaatcatttacattattattcatttacaatgaatagttacacaatgaaattatcacactcgccacgataacaccgatcaactaacgttgatcgctctcgtgttatagtgtccagataaaggggattcacaaaacccctttggtcaatctggacattgttttccgtggcgaaaacaacccgtaagggctttgtgttatagtgtcgcgaggtgatgaaagtcaattgatccggtcacaaagtgatcaatgttacacattgaccgccgagcggcctagatctttttattagcaataaatcgccgttaatggttgacaaaccatgattaatcgatctgtaaatcaggccgctggcctgctgaaaggcttgtttttgagcataaaagatgcctcaagtgtcaagctttttcttgataggaaaagtctattaatcccttgtgtagcagtaatacagaaaatagttacaataagtaactatttcaatgctttagcattgccgggtatccggtccatcacagggctaaacgagaattgttatcatgtggcaaaatgctcaaaagcagagtattgctaaaaacaattttccctccctgtcaagtgttttatgcgaaatttacaaaatatttttatttgcggaatgattttcatttagaaattgaaatgaaaatcgaaattataatgattatgaaaagcattatcatctacaaaacaccccacaaaatgaataataacaggtgtaaactgtcacagtggtaacatatagcaggctaatcatcgtcatagtaatggttcattgatgcaatggtaacatagtgcaactatcacccatgcaacagtccgatctgtggtgcgtataacgtgtattatgttaaatagaccaacccacacaaaagtaagcaagtcaagggcaaatcgtgctgtaagctggctaatcaatcaaatcatcatagtttcattaggcaatcattagtcacacaagtaatcatcatgcaatcatcgtgccaaaaactcgcaagggtctcgacatcggaccactcagatattttgtaaagatccttgacaaccttcgggggctgtgattgtccgtctagcacatcagacatagagccaacggatatttttcgtccccaagagatacaagacagggcctcttttatttccctccgggcgggggaggggtgggttttgatatgtttacccgtatacgggttagcctgtggctaatcgccctgcgatatgtttacagcatcgacacttcaggctacatgtgtcgaagaaatgcaattccttaaacatgttgtgttgcagagcaatgaacgagttcacccgtgcaacgggcattgtgtgttaatgaaatgtacaacctttcacgcaggagcggtggtacagttcaacaatcaggacatccaacgtccgtaaagattgttgaatgagaattattcaattctcaggtgcaaggcacccttggtgtttgtttcgtgcagaccttcagcacctgtgactctttaggtaatagtagcagggctgacagtttacgtcaagaggaaattgatgtgcctctttagacaaaattgatgggactcttcaggcaggaatagaggagccacttcaggctccccttgtgtggtgggtcacttcaggtaaaggtcggtttcagagtgagaagcagaatgatggcaacaacagcatataccgcccgcattaccaatttgtgtggggggaatctttgttgttgtcctgtctcaggataaactctacggctgcattccagcccgtacaataaggatcgctcccacggagtttggcccccaaaataaccatctcccatctttcatttttgcaaggcattgcctgaatcctgaccaaaaatcctcaacatcatctaagatctgtgtccagtttgtagttgctacacccgtaccgcttaggtaggtgctacagataccgtaaagttttccgctttcagacaaggcaagcaggtctgcacccccagccattgcctttctgatgcttccggcggagatgggggctttaccgcccaagagcatttcaaacatattgtcttctccttgtgtaaaactctattttaccataaaatcaagagtttttcttcttgaaatattgcacagcggccttttctgcttgcccctctcgtttgaactccttgttcttgaagcgccacttccctgtatcgctatcctgccacacttcccgcttgatgaaatcaagaattgtatcgccgcccatctctttctccttgtgttgttggtattcctcttcagaatggaaccactgatcaattgaatctttgcggatctctcgtagaagctcctcgtagcgtatgctttgcattatgtcctccagatgaggtgtgaaaaacggaaaagcatttctgagaatctttcatctcccatgatatgcttcgtcaaaaaccagcctgcaaccaacgcacacgcagcacatgcgtacatgaccggataaatcttcatgtccagcccaacatataccccgaacatcactacgcaaaacgcaagtgcatggatcacaatatttacgattcggtagatcattcaatcaccttcactggtgtgaaagtatcgggaagtcgcccaccactggcccacgccttgcacccggcgtaaccgggaagtcggttttctttactcagtaaccacggtacatgcgtactttcgaagtacctgcgaccactctcagactcatagaacaaccattgtccacgatctctttctccagtgtcggtccagttgaccgtccaagtggatgttccgatcagtttaagcttgcgccttttccaccatccaaacattcaagtctcctctgaacatatcgccaagtttttctgtaatgttgcattacttctaccgtcttgtcaaacggtactttacttttcaggcagtaccactctccctcgcgggagcatgggtccatagacattctgccgtagatactgtacgtcattgaagacctcttttctggatcttctgtgcagtgtgtattaatgcgtcgataagaagcgagcagtttgccctttcctgggagcctttctcagcaccattcctgatttgcatacacaggtcgatatcactcaggatttcttcaagaatctccttcctttcgatcattctcccaagttcttcccttgcatcaccatacttttcacacatatcaatctcctatccgaatttattccccattatggcagaaataaatattttgtcaaccattgactaacgcacaattatcaaatatgatgtcttaaacaacccaataaggagacaccatgctgatgttagaagataagggcggtcgcccggaccgtaatgagccagaccaacgtgtgcgcccggatacaatctgccttttatacggattcagccccaagaacccgctcacattccagctaaacggcagggtgtgttatgttcttgaacgatccaagattggtccaaaccgaataccttacccggtggacgatatttggttcgaatgtcatgtccgggggatgccaacaacgatggacattcctattgagcacctgacagttcttgatgattcggacagtctggtcattgaaaggatgacaaaggactgataaaagaaaacccgccaatggcgggttaacttattaaaacaatcactctttctttgctttcagagacatactcctcaacaaacattccagacatcaccctttccaagatccttccgggtactcttccgaatttcttcataaggatatcaagatccgcacccttgctcattcttagcatttgggcttcttcatctgttggggatgatgagtctaaaaacatatctcggttgtatacctcgccctcaccgatgcacacacgatcaggataaatccagattttctcatccttgttcgttgttatcaaaaagatttgctcgttttttcctgcgctcttctttattgtaagctttggataaagcactccatcagaataggcattgtgtttagccttcacaacgaaaacgattgaccattctgatccggatttgacttttgccactgctccggatattcccggcagtttactgatcacgctgtgatttgtatcctttacaaaaagctttattaattcgtcctgcatagggtctccaaatccttaatccactccagtcggttggtgtagatcatgttgttcttcttactacggttcaattttgcggggataacttggatattatcaccacagtttaggccagatacaatctttgcacggaggggcagcatgtggtcagactcccaaggaatgcctgtgtcacgcatcctctcgttgcaaagaaggttggcctcttcacgaacgaagatgtcccactcactattgagtgttgcacgtttctccgcctcaattctgtcaaggcggatttgcaattgtcttgcttttccttctggtgtggatcgacgctgacggtctatctcacgcctccgggcggcatactgtttgtaataatctcctctgtccctcatgcaatctcctcaaaataatggataaaaatacacaaccacgctaattattgcgtagataatgaaaacggcaaagaaaaccttgtttggagggttcctgaaccagtctttgattctgtatccccatcccagagacttcttgtgctcattgatgatgatgtcgattgttctatacatgtcccggatcgccgtctcaaaaccctcgtactggtcgaaagcctcttccaagtcatcaggatcgagcttacccatatctccaacacggaacgtgtatgtcattgggttttgagtgtcaacaccacgagttacctccaatcgccctacacgaatggtgtaaaggatgctatttttaacatccctgatgattaaaactcttttccagcagagtttgccagtgttcttgtagggtagggtgttcacgaaccaatttctgaaacatactacctcctatcataatattaacctccattttatcatggttgtggcaaattttatataggaggaaggatcaatcacacaaaggttcaaaatcctaagtgattgcaattaccgcctatcaacatgtgaaagaacacttcgggcaggggcaggagatgccgtgaacacacatacccaggccatctttacgaatacctgtcccaccgcaattcgggcaggcatcgtgcatacaaccaacaccaacattctttgcaatatccttgaggtcgttgcctgttgcttcttgcaagaggaaacgcttacgtaagatctccgcctgctctggcgtcaacaaaccataactcataatgtgtaccccttacactgtaaccacacaaaaaaatcaccaagccagtcctcctggtctcgaatatcgggccagttttctggttcatcagagatgttacggtgcattttgtattcactttgccattccgcaaccaactcgaccattcttcccataaattcaagctgtctcatttcttctcctcataacataatggaccaatgccccaagcggccaggcgaacccgaccgcgaagcaaatctcagaccaatcatggtctgtcttggccttgtaaatctgacggagaaccttatcgttctccatctttatggagtataccacagcaataacagcatatgcaaccccaagtataccgattactgcttcaagcatcgatcttggcccagcagatatcttgagcggtcataagtacacgagcggcgagttcaagatcggttgtttttgggagatctgtctttttgtacaggtcttctcggatataacgatctttctcgtcagcccaagcaagaagctcttcaagggtccacttgccaccacggatatcaagcagttcctgagcgtcaggccgcttaaccagaactttaccgtcagtaagaatctcttccgccatacgcatcaggcgcacgaggtgcatcgcatgtttggtatcgtatccgaactggacttcgagttcatgacgagcctcattgcgattttccttccacgtccagtagttccggtgcttctctttcgccagcttgtgctcttctgccagatattttacgataaacaaaggcttacgctttttatccgcatcggtcagttgctggtaatcgacattacgaatcgatccgtcagcattgaataggccagaactattaaagttctccatcacaccgtaaacgttgttaccgtaaggtacgaggatgcagaagctgttcaggccgtccagtgcctgcatgaaatcctcatgtttcagtaacgggtgctcgctgtagttatgcaccaagcggaaaaactccttctgggttggctttgcttcaggttgtggattgctgatccacttatcgtgaccacgaatacgcttaagctgtgccattgcatagcctgagaagctaaaggccaccttgctcgatagcagttctggtgccattgtacgtagatagtcatacgcatcagagctttgcagaatatccttctcatctacgaacataagctcgatgatgttggggttcatctccacgaaaagcttcatgaagtttgtcagttcataaatcttcccatcttcttcgtcagcaagggtttgctccttgatattgaagaatggtgtgcggatgaacttcggttctgcacagaaaagccctcggatatcggtatccgatgttgggaggttagtcccataagcgatgctgccagagtagcaacgcatcaagtctacagttttcatatttctccttaagagcaaacaagattggatggtcggtttttatcccagaaattcaagagatcttggtacttgatcttctcctccaagaatttcgcctcgtctctcaaacgaatgatctcctgaatcaataaaactacctcgtccggataccagcctgttggctcttctgccttgatcatgcactcgcccgacttccatttcgacatggaataacggtgtgctggatctgggtgattaggccaagaatcaacaaggattttcgccttatttcccttgatttggtttaccttaccagggcgcaattcattgcctccccagtagatataaacctcgtcaccaatcttcaagtcctctccacgaacgtctttcatttatccaccttagctcaagtagctcaccgatacaagcacaaagaaaagaacattcaggccgatggataccagcatcttttcgttcttgattactttctcctgcaagattgcacgggcagacaaaatatgtctccacatccaaatcccaaacaggattcctgcgaacagcccagcagaaggtgggatcagggttgttaccatcatcaagccctcgataacggcaaggcagacgaacatggagaaacttcttgcctccatcttgaaatcttccccgctcatccagtgacgggtcagcaataccacaccaagcagggtgaatagggtataaattgtgtagatcattattcggcgtcctttaacagttgttgttcaacaccttttaccacatcccgcagggcgaggtcaaagaaattcgtattctttttgtaatctgacccgatagttcggatctcagtagtagcgatcagcgtagctgaacggatcatctcgataatcacactgcggtcaagttcacttactttcatcttattctcctttcagtcggaatgatttgatcattgtgatcaggtctttttcaggttgtgtgtagttatgcaccacatttcccatttcatcgcggtactggttggctaccacaggggcgatgtacttaccgggttggtacagattgaccacatcggaatactgcgggtcatacatgtactgtggcaataccacagctactgctgtcatagcgccgttcagtgcatcctgttcttcacagaaagaggcccacggataagtgctgctcagaggtttcaacttctcacacagttcttgcaatgacgactggtatccaccattgaggacgatcacggtcttatcgcggtcagcccaatcccacaacaggtttccggcattgttccggcgttgagagtaatccaagaacatctcagacatcgcgtgtgctgactggatacctgcgtgaatgccagcaatgtattgatttaccacgcagtacatacgtgtcttcatttctttctccttgcaataacaaaatcttcttcaaaaatggcggcaatggtgccacccaccaaacagaaaagtccgagaggccaaaagacgatcatcagcagcccgatgccgacggatgatgaacttatcttatccatacaaaaccaatccaacgccagaatcgtcaacatagccagtataccaatgcacaaataaattacaagctcaataggcattatttttcccctatttgaaaaattgtgtgaacttaaacatggcgcttctgtacgatggatgcaatgcgtaattgcatcccttatccacgcaccagtcgcttgccttgttccttaaggccacgaggccgcaccatgcacaaacctgcttccctgcgtgtttgtcagcgtaaaagtgatgtttctcgtatgtgtactcttccttatccgatttcttcatacagaactccttaccaggcaatttgacgctgtgtgacgctgcggattgcgtcgatacgtgccaccctaatcatttccccgatctcaatccctgttttgcccttgctcaaaccttcagcggagattactttggtatctaccgccaccatgcaccggaaagcatccatcagaacgtagccctgtgggtaaggttctgctgcctttgtcgggccacggccttttgcatcacagaaacatgcgtcagccagggcgctgaccttcatagctgtcttgatgctctttacgttaccagcagcttcgaaaagcttcattagtgatcgcggttttgcacccttgtttccaccacgaggggcgatgcaatgaacacgcgtatggtgctcagtcacgtagcgagcaacgtcacggaaatcgtttggcacacgaatacgttcacacagtgcatcaaccggagcaagccctgcctcttcatgaccgagcaggttcccatacttggagaatgtcacggccttgccaaagtcgtgacacaggactgcaaacttcgtgtatgggtttgcctcgtactggtctgcgatatctaggcacagcaatgtgtgtatgaatgcgtcaccttccggatggtgttccggaggttgctctacaccacgcagcgattccagttctggcaactcgcccagttctgccattgcttcagcataggaacggaagttatcagacccaagagccttttccatctctttccacttacgctcgccactgatactttcaagttcgtgacggttctggtaacaaagagatttggtctccggatggagatcccattccttacccaactgcgctttgaatctgtaagctctcagaatacgcagaggatcatcaagaaacgccaacgttgtgtgtcgcaggaccttcttttcgatatcatattgaccaccgaacgggtcaatgatttctccggtatccagatcctgagccatcgcattaatagtcagatcccgacgagacaggtcttctgccagtgttacatcagggctgaaaaaggtctcaaaacctttgtgaccgcttccaaccttacgttcagttcgagcgagcgcgtattcttccttggtctccggatggaggtataccgggaaggaagcgccaacctgggtgaaccctttttcaatcatttgttcgtgtgttgcacccacaaccacgtagtcacggtcgtggacttcacggcccagcaaaccgtcacgtactgcgccacctaccaaatataccttcatcttttctccttagaaatcttcgtgaatatatgttttataaatttgtcttaatgatttcttgttgctgaagatgtcatactcttcaagaccagtctcaccctcaatgaagaaggtaaattgcacactgttccaaccatgcccgtgattagacaataccacttcggtgctcgacctgtcaatagcaacttcagtaacaagaagaatttcttcctgatcgtgagtttttaaaaattcacgggccttttccatgtcgtcattccaaccattctgggggtcagtcaattttgcatagagattcattcggtgatccccagttcttctgcggtgtacacatcgttgccttcataccaaacaccgttgatacggaaagcaaaaattcggtttaggattccaccaccaaacccatctctgcttctggattttccacctttggtaagaaatacatcgctacggactgtagaggtgaaacaaaactggccttcttggtcgaacacaactacagcggtatcagcaggaacttccacaattgtggttaccacctgacccactgtggagggtgtccccatgttctcattgcacaggtctttaacaacggtgtatgttttattaatcatttattttctcctgttttgtttcagtttagacaaggccgtactgcttttgtaacttccattctgcatcggtgatgtacattttacgcactgtttgtcggatgtcgtaaaagccgatgtcggtgtctttattttcagcgtcgtacttttcttccccaagggcttccaaaatagaagcgtcgtggcccatcgggtcataacccagtgctgccttacggaacataaacaaccagcgtccctcatcgtcctgctcgtcgtctgccatttccgggagactgtctgcatgttcctgccagtagttgtacagcttaacagcgtcctctggggatttcaagccaaatgaaaggttttcgttttgccatcccagccaatcagctatcgccaaaagcttttcacgggcattgagttcggtcatcatcattcccctttgtaaatcgtcgccatgaagtcttcacgataaacatccttcagttctgcggagaactctttactgccgaactcgtgcgtccatacggatcggcccaggcgcttttcgacatcttcgtgaaacaggttgaacggacagcaaaggattcctgtgaacccggtgatgatcagggcctgttctttggtaagactttgtttcatttgttgttctcccattggttcatgtatttgaccagatcttttagtgatctatttccgtcgagtggataaaccatatcgtcctccatcccgccgtgtttcaacatcttgattaatcgagtatacacactctcagggcgattgcaacgttgaactttccaaatcttcccgtcagggcagtaatccttctcctctgtcgagatatggataaggtcacccatgtattctccgaagcggatggtctctaaaggacggtagtaaatgtaaaatcgcatgttgttctcctctgttggaaaacagcttaagtgtttattttctccatgtcaagtacaaaaacgaaaaaacccgccgaagcgggtttatttaccatgttacgaaaaagtttattgcagtgccttgttttgttggttggtagctgatgatatcgactgtgaaaccgccaccacgaagatcgccaacaatatggggcagataatcattcatctcctccgggaactggagagaaagtcccatcccgtacatccccttcctcgcacactgcgctatcccgtccactatctgatcgtacagttccttcagtgactccggggtttgcttttctccgttgtttgcgatctctcgcatcttgtttgcgacattcgtcactctgtccctccaggaaataaaatggcttcaggccgagcttgtttttcttgtcccaaacaaaccaggcataaccactgccatcggtttttccatcgtctgtaaatgatggcctttgagaaagaaccaaaagagaactgattgggttctcctgccaccactcccaacgcttcatgctctcaaggaatcctatcctcaacaacatgatcacaacatccgcctctccaagtgccttggtgacgaactcttgcgccaaagagtatggtgggttggtcacaaccatatctacgtggttgtactcggtgttaagataatctacgccctgacggatttcaccccacgcgcttcccaaaggcaggaagttgtagatcctaccggagcctctgcaaggctccaagtaagttttggtgtaatcaatcgggataacctttaaaagggcctcaacagcccaagtcggggtttcgtagacatcgtatgccctgcgctcttccttcttttttaaaggtgcagacattagctccccatttgctccagaatacttgcaacgatttcctcagaggctttgaggatttcaccaatcagttcctggcgatttcgagtggtaaccttcagaggttcttcagagcctgctgccagcgcaccgatctgagacaggatggattgcagttcttccacattgaaggcatcaaaatcttttgcactcagcgtggatacatcgaacttgaacatttccccgtcaacatcaatcttcagaaacacgctctcaggctcaccttctggcaggttgttcaggtcaacattctcaacgacctttttctcctctttagccttcttctccccggaaatgattgggttctgaccttgctgcatacgtttgatgtttttctcatccaacagcaccgcagtggtacgcttaacgatctcgatctcatccatccacacctgaccaccacctttgatggttgcaatctcagtatcggtcagaaccccggtgtagaaggtgtcgatcagacgatcaaaataatgcttctcgaatgcaatctgagcgtacatgtttgcaccatcaccgaaagtcccgccctgataattatggaacatgaactctgtcagtggtgacactgtgcgatccttacaggccagccacaaaactgtcccggcagaacaaacgttgccttcggcatgggtgacgatctgtgcctgactctcacggatcgcactgacatacgccatagcgatagaaactaccccaccaggactgttaatcaccacccggatcgtgtcatcagggcttgcctggcggataacttgcagacgatcctgatggtcttccagccatgacagatcatcaatgtagatgacgtgatcgtgagagtggaccgggtagctataaatgttcccactcatccccggcagcataccgaaaaagtttttgttctgttccatgttaatcctcctcgcgagcgtttgcaatgtagcctttcagaatgtaagcattcttcatcagccagtcaatgtagtaccctgtctcgtcatccacaagcacttgatcgctgtacttgaatgtcacgagaacttttcttgccctctcagaggctaacgctgctgtgtgcagcaatgtgaactcattcagttccttcggactgatattcacataactcgattcacgaccctgatgatccagataaatcagatgattaagtagatcacgtctgtccggaaacatccaacgagcatcacgttcagccaccttttcgctgtagataatacgagtaagaaacccatcattcatctcgtacaaactctgtgctattaccttacggtaaaaggtgaaaagcttcgttacttcttcctcgaaaaattcaggctcgacaacaccacaattcttcagttccataagttttcgatgggaaacaaccccatgaatactaactgtcatactcctcctatcgagctatcaggtacttaacttcaccgtcatctccacggtatcctgcatccacaatgtaaaacagcccgaaattgtccagctttactgtatctccgaccacaagagttttcttggactcgtactctagagattcagtcagatgtttgaactgattcgtgtcatctgtggtgcaaacataacgaatctccccacctgcttcggtaacataaatccgttttcccgtctttttagccagaacccagccctttctttcaaccttcacaaggcagtaggactgattcagcttctctctaaacctggacacctcgtttcctctcaagactggtcaggaactgctcaagcaaggccaagcgctccggagtgtttaggttaagcgtcctcacgccatactttttggcgagattgacagccgttgcagttccgccttttgggttgccatgcttatcttccgaagcatagtaaaggcagaaggcagagggctttggatcaaggatgtttgctcccagaacttgatgcacattacgggaatggagtgcaaaagcacctcttttccttttcagagcctcataattcggatggatttcctcaaccaactgatcccttttatgcttttgttcaggcatgagatgatcaaggtaactcaagggataatcccagaagtcccaaaggtcttcattgtctgaagcaaagccgtcccaagggatgtaaatctctgccaagcgtgtacgatactctttcttctttccattgtcaagagtttcgtcatatttttgcatccctctctgaaatgcagcatccgctcctccagctttcccacttcgaagagtgaatccgagcctggcgagacggaaagcagcgtcttccatgacgctgataacctctgggggtgtttcgcgtgatcctaccccagtataatatgccatattcctcctgttaagaagccatcggcgtgtacagttttgcgtcacggtcagccatcaggccaagagcgatgtcgcgaaccataccaccacgaacgatatcctcattcgggtcatcaaaggacacagtacccacacctgcaaggttgtgtcgctgggtaaactcaatcagccactccaggccagactgaccataaatgtctttctgactggcatcacccatcacaacgagtgtacagttatcggaaatacgagtaatgatactcagcatttcttctggggtactctgctgggcttcgtcgatcagcaggaagctcttttcgtcgaatgaacgaccacggatgctttccaattcctgaacttcgatacgcccatttaaaccgtctttcagagcattgtaatatgccccgtcgcccatgcgcttgcggatggtatccaacatgttacgaacataggggaacagcttttccagtgaagtacccggtttgaagccggaggttttacccgtctgcacgtatggacgagcgacaatgatcttgtcgagttcgtttctacgtagcaagtcggcagcgtgggcggatgccaggtaggttttacctgtcccgaagatacctttcgcaatgatgatattgcaagtttgcaatttgtgaaggtaatcctgctgcttttcattcagagcaaccagagccggggcgctgttacgttcctcatcgaatttcgggtggtgctttgcttgtctttctgcacgttgttgctgacgagccgaaagttttaatgcacgagcctctttgcttcttcccatattggttctccttacgaggttagaacagattttgcctttttgtaataggctgtgcgctcggcaaggtgatttgtaccaccgtttaccagcttggtaattttcacgatatcatcagcatcgcaagcggcgttgatgtttctcgtgtcccaataccaaccagcgctggcaactgcatactcaggctgttcaagcaactcagggtggttaacgaggtcaagaccgagtgctttaccgcaagccttgtagtttgcgagtccggtcacctgaatcagacctctccccttgtacttggcaccatccccatctttctggggtgtgtttccaagtctttctgcaataggaccagtgtcgtacttgtcaaagtaggcatcgttaccgagttcacgtacataccggaactccgccgactccacaccaatctgagacaggaatcctgcaacccgatttaccgtattaatctctgtcttttcaaacaggtcattgagcggcttcaggaattttgcattcctcccagaacttgcaccaacggggaagattttgtccagttgtgcttgggtgagtttcaaagtacctcctttattgtttccactggtagcctgtgcaatgcacttttgcagtgcggcttttgtagcgggtccgtacaatccatcagcaccagacttgccgacgctaaacccaccttcgatcagcatacgctgaatctccgcaattgcagcattcattgaagacctcctttcggattagccctctccgagcgcctcttcaaaagccgtttcaagtcgggcggcaatcccagaaatcttgatggtgatacgttcttggtagatcgcgtaagcaagctcgtgcggtgtcagcgcttctttcagaaggtcaaccatcgtatccatcaccttctgcataacctcttcagaaagagctttcttcagcttaacctgagcagcattaagctctttctccatcgcagcatcctggcctttacgtgcgtcagccttcatttgctttagggcttcaatttgatactgagtttgttccgtaaactgattgatcagtcttgggaaaacaaggcccacaaactcacgggccagttcctccgaatctccgagcagcagcgtttccagttgcgattgtggcacaaaggtctgttcttcgttgataacgtcagtcatggagtacctcagtagttgccacgggcagcagcgtcagctaccagttgcatcagttcgtcttcagtggtgcgcttgttcttacgctttttgccacggagttccagtgccagttctttctggtatgccttacgcagtgtcttcttactcatctacttctcctctatccatacaccgtttatttttacccacatcctctggttgtcagaacctctgaaccttttggttgtaggattgcactcatcatacttgccgtccattataatgtcaacaagttttttaaccctttcagggacttcttcgaaggtgtatccagtccacaccatgatatccctgctatctccgaatactgcacggacacgcaggataacttttacgacctcatcaacattttgcgggtcaagtggttcacctccgagtatcgacaagcccttgataaatggccttcccatatctttgatgatcctgagaacatccgcattggtgaaaggctgaccgtagttatacgaccaagctttttggttaaagcagccacgacatccgtgactgcaaccgctaacccaaagggagcacctgaccccctctccgttcacgaggtctgttggttcataaccacagaaattcatacgtgtttcaccctttgcagcacctcttccatcttacccttgttgtagggtcgtgagtttggtgctgacagatatccggaaactcgacgaatcacagaaatcgttccttcttcatggttcccgcaagaaggacattcgaatccttttgcagtcgccttgaactcaccgctgaatccgcatttaaagcactgatccactggctgattgataccgaaataatgaatgttctcgtacccatagttaataagcgcttcaagagcctgcatattatgcttcaggttcggggtttccacgtatccgatattaccgccgttactgatctctgcgaaacctgattcgtaatcccacttactgaatgggtcgctgttgagccacacaggttggtggaaagagtttgtcaggtaatctctttcaatcaaaccaggatgtttctcctgtaacttgcttgcaaagcgataacacaggctttccgcaggtgttccatacaggctgaaacctaacccactgcgctccttgaactctgcacagatatccttcatgtacttcaggatattcatcgccatctccttgcgtactggctcatcataaaggatttccacagcctcataaaggccgacaaacccgatactaatggaggcgtacccgtcatagaagagtttactgatcttctcatcaggcccgagccttgccagagcaccttccatgaacaatgtcgggttctgggatgccgtaacatccatcagacgaccaacacgaagcatgtgtgcctcataagccatttccatatgcttatcaagcagttctgtgaagaaaccttttccggcttttgcttcggctgcaatcatgggtaagtttaatgataccacgccaagattgaaacgtccatcgtacttttctccattttcggttgcaaagtgagataaaaagcttcgacaacccatgctcgtcaccttgccgtccgaagatccggtcacttgcatgttcaacggtactgagatgaagtcggggtaaattctctcagcacaacactccatagccagcaacttcagatcataattcggatcgccaggattcatgtttacaccttccttcaggaagaacacaactttcgggaacactggggtcaccttatcagcgccgaggccctctttgtggacctttagataattataagtgatcatcctaccgaacattgatgtatccaaaccaaggctgatcgtaatgaacggagactgaccatttacgctcatcagggtattgacctgataaagcagtgtctgcattgcatcataaaccattttgttggtcggaccaacggcgttcctgtggctctggaactgcttcacattcttcatgaagctcatttcaacgtattgcttcagaccttcgtcgatgtgagcacaagtctgtccaccatactggcttgacgctacagcctggatgatttgtgtcaatacagtggttgccacaccaattgatttcggcttctcaatcttagcattgccgatcttgaaaccattttcaagcatgtcccggtaatttaccaagcaacagtttgtcagagggcttaccaggtaatcaaggtcgtgaatatgtccaaaaccctctgtatgccattctgcgaggtttttaggcagtatctgggtcaatgccacatgtttactcaaaatccccgctaagaggtccctgtgcgtgtttacgaccgtgcttggtttgtttgcattctcacgggtgaactcttctgcggattggtccaagaatccggtgatatctgcataaagttttccctttccttcacgcgcgttgtcacgatcatggcgatactcaatataggcgcgagcagcgtcacggagtagaggttcttccatcaacagattttccacttcacgatggaaatcttcaacatgtctcacaggtgtcgtcatgaatagcttgaaagtcctctgaccgatacggaccgcagtgtgatgtgctgcttctgggtccatacctgttgctaacagagcggcctcaaccgctcgtttaactttttccagagagaagtcttcaacacgcccatcgcgttttactactttcactcatctaccccctcagatgtttgcattgacgtatgcaatgaactcatcggctgttccgatgtaccgggtgctggtttcatcatccataaagatacggggtacggttgtcgggatcactggagagcattttgccaccagttcctctttggtgtagtttttttccaaggtcagatacataaactccagacctttggatttagcgaactcttttgcccggacgcagtgttggcaattgtccttgccgtagataatgaaaatgttgtctttgatactcattatttctccgtttcgaaggtaaaaacaaaaactgggatgttgccagtataatcaacgtcataacctttcacaaccatatcagccacaaagttacaactgtcgtggaatggtccacttccggtgtactcaagttgcaatcgcccttgctcacccagaagctttttcagtcggacaacccaagggctttgaccttgaataaagaccttagcacaggccacaccattcagacggcgagagcatgaaaccttgacatcacaatccaggcccataatacgctcaccatcgaaagtgacatgaatcttggtggggtcgtaagcaaccccgaaatcaaaaatcgaattgtccaatgttactccttaaaagtcccagacttcaccgtctgtatcgttgactgccgcatttaaacgataatccgtgtttgtctgctcctggtttgcgttctgctgacggcttggattcatccagatatccataaacggcagaggatcgcgcttaggagcttcgaaatcttttggaataccgtagtagtcataaatcggagcacagttccagtcagtccagtctttcaggagcggcgcattcaatccgatgattgcacgaccatcactgaacaggtaatcaccccaaccatactcttttgttcgaacttcgtcaaggatttccttgatctcgtgcttaatggcattaaaactagccttccacaccgggtctttcagaaggatatcaataacctcgaaatccatcttggtgtgcagcatttcatccagcatgattttctggacaagctgaccgacctgaacaaacacaccctgttctgccaaggcaaaggtacacgcgaagctggagataaattcaatcccttccagaccgatcagcgcgaacaatgcacgtaggatacaacgtcgaacctgttctttgtctacagactcaggatcgagacgataatgtgctccaagaacttcaagttcacgcatgtacttgacgatcacaccagaacgttcgagaactgcctgattgttttgaatatcttcaataatttgccgagagtttggcaaacactgacggacgatatcagaataagtcagggcgtggagaacttcgatctcagattgcttcatcatcatggcgaaaagttcactgtttgtgatgaaaggtgcaaacagacagatgatcgcctgtgctgcaacactatctgcctcccactgccacatcagggtctgaaccatgacatcatacgtggatttgctacaggttgcaaagtcagtgattgactgatttagctcaacttcgtcttcagaccaatcctgttccttttgagccttgtacaggtcaaacagggctgggtattttttgtagatggagtcatacagacccatttgctgtccgaggaacagcggataatcaccagttttatgagcggtgttctcagcgttgaatactgccattaattcgcctccggaaaaataggggccgaagccccataagaattacaatgcacaaccttcacagtacgggtcttcaaccgaggtgtctgcaatcagtggataatccttgcgggtctcttcctctgcttgcttcttcgcctgaagttctgcggtgagtgagtcgccagcaccaaccttcgagttcaagtagtaccaagtcttcatccccatcttcgttgcacggatcaggtaaccgatctggtccttcatcgagatctttccgtctttcaactgggtatagtcgatgtagaggtcagcactaatcgcctgccctgcgaacttctgaatgacggcgtaaatgtcaatcaggtcgttggtgttaatatcccacgcagaggtgtagtaatccttcagttcttcatactcaggcacgataaacagcacagacccttgcggtgatttcttgaagataatgtgatctcgcaccgggtaaagcccgttagtagtgttcgtcgccagagaagaactttcgttcggcatataagcttccaacacactattgcggataccaccaacttcgataatctcttgtcgtaaagtttcccaatcctgcttgagacttggattcttcacaactccatcaactgccttgttgtaggtgtcgattggcaaccacccttgtgggtacttggtcttgttcatccacggagctacaccacgctcttttgcaagacgcaggcttgccttatgtaagctgaagctgtgcagttctgccaggtcatgaaccaactgcttgctctcagcagagccgtaagcaaccttgtgtttcgcaatgtaatgagcaaggtttgtcaaaccaacaccgattgaacgacgagacttggcagtgtgttccatattctcatacggataatccatgatatccataacgttgtcgatcataagaacggtgtagtaagcaacatcctcgtactcttccggagaaacacgcccagcaaccagagatgacaggaagcaaagagcgacctcaccatcgtctgcaaaggtatcaaagatgttacgcatatctttgtatcccttggtaggcagacagatttcttggcacaggttggaggaataaatcgtctccaggaaaggcgtgtgccggttcatctcgtcaggccagtaaacgtacaggcgacctgtttctgctcgttgggtaatgatctctagtgccagatcgcgagccttcacccaagttttagggatcttagtatccgctgccacacgagcaacttctgcatcaaattcctgcatggtcatcttgaacataccttcgtgtagttgaggtgcgtccttgtaagataccagcatccagtcaaggttcttcgccacacggttcatgaacgactggttaataccaatggagtaatccattgtgttaatacgttttgaagaaactgtttgcgggttcttaaggcgcaacagttcttcgatctgcgggtcaagggccaggaaagagatcgtagcagaaccaccacgggtggactgacggttttctttcaccccggcatcaatgccacggtaatatgggagtttacccatgtgtttgatcgtattgccacgaacgccgtcaccaattgagcgggaggagaggtagtagccaatacctgcctgtgcaactgtcatcgtatacgcaacttcacgagcaacaccaatgcttttcgctgtatcgtcagccttgataatgcagcaggacgcatatccagttcgtccggtacggagaccgttcagatacggtgtcggagcattgatcttcagatccgacagatacgtataaagcttaatgacatccttgatacgacgatcacgaggcatacgcttcattaccgccatcgcaatacccataaacatcatctgcggtgactcaaaaagaacatcgttgatgttgtctttgataccgtacttgtcacggaattgcttcaggacggcgtagccgtagtcaaggtccttggaatgattaatgacactctcaagttccaccaactccatctgaccataacccatgtcttcccagtaacccttctcaatcatctcgtgatagaaattataaagagcagggatcttgctgaaaccgccataagcttctttgtagatctgcccgatcagaactcgcccagccatccttgaatgggcttcgtcttttcggctcacgcaggcatcgatcaatgcttggtttacttcacgagtggtgcaaccatcatacaggcgcttgtaggcgtccatagagatatgtgaccagttaccattaccgtcatcaccaaagatcgctgccttgttcaggcgttctggttcaaacggcaccttggttccatcactctttacaactgtattgatcaaactttctccttatttttcttcgaattgagcaagatacttatcagcttcgtcaacgtcttcgtctggtttatcatcctgacccggcgtagtgacgttaactattttaccagaatactcatcatagtaaacatcgtcgtacatcttgctgtcatcggttaaatcattgaagtagagccacccggcgtagtgatgcttgtcatcgaagccacggtctttccacttggtcttctctttactcattattcccccagaccaaatgcgtcactgagacgtgcttcatcttcactatcgaacgtaatatcaaacgaatctggacgatctccacgtttggtgtacttacgggtattaaccttctcattcactggaatatcgtatgggagatcaagaacgaactccatgtcgcgctcggagtaaatccctacgtcgagaatatcaacaccgttataaatttttgcatacggataatccggacgcatgtcaccaacaaagattgttgttttacggtacgtatagggcaaattcgcacatcgtacatttttcatgttaagcattgttacttgcttaggattcccttcactatcggtgacttggaagcctactgcataaagggcagcacggagtccactatcttgggttacatcgaatccgggtacggttctcagaaagtccaaagtgaccgaaatatgttgggttggtttgcgttttgttttactcatgtaatctccattctgcctataatcggggagtattttctccccgcaattcatacatccaagatacgtattactggaaactttgtcaaccagaaactacgttatttccagttgttcgctcacataacgcccagtcatgggatctctcagattttcaggcttcagccctgtttctatagcatgttcagtgttctctttctcggttacccattcaagatttgagaccttgttgtttctcttatcaccatctttatgattcacaaatggcttgttgagtgggttaggtaggaaagcctcagcaatcaacctatgcaccctgaaagtttttacaacaccgttgtttgccaatctaacagtcagatagcctgtgccatgctcagaacactttcttttctttgcagggacaaactgtggcgctgttctttttccgtggcgagttttctcaacccacctttcaagagaccaaacattaccatcagtatctacctgataaatcccttcatatccagctacatcaaccttcaacatagttattaggcagtaattgacgcaactgaatccagcctcgatagttcccactccataggcgacctttgcgatcaacatgggtaatgccttcttcccaagaaactgggtattccgccaaattgatgcttgggtcataaccgtactggctgaactcacctttcatcggggttgcaacatgttcaaaaggagaagcgtgtaccttattaccgcttaaaagtttcccataaatgtctaaagctttctctttcgtgttgttaagcacacgataagacacctgagcacaacaagatgcagaaatagccttagcttcatccactgtcaagatcactggtttgttgttctcgtcaagaacacagtaatcaaatgtgtcttcacttgcctgctctcctacagtgtataggtgatcaacataaggggtgtgccattgccctggcttcagatattcaggtactgattcgtcaaattcctttttcatggcctctgctaaagcgtagatggttggatcggcatccttatctaccctcaaccaccagaaattctcaaagtcagttgctgtcaagaccgttttcattcgctggaaaggctcaagcaggcggttcgcgatctgtttgtggtaaccagcatctgcgaattctgctgcaaaccgtgccgcacttaatcctgcgagtttccaccaatcttcagccgaatacccatcaccaagctgtgcgtcatgctcaccagcatcctgcattcctggttgattctttccaaacttaactggcattgcagggtctgtctgaacctgctcgatcatctttttgatcgggattgcacggctactcatagcgttccgactgaacagacggtgagtcatcagttcgctgtgaatgatacgagggtactcaagctcaaaagttgtaatacggcgaccctgcggtgaaatactatccgcgacaacacgggcaactacagcttttttcattattgtgctccttccagtttcttatacagcgactctttgttttcttctaaaactttagcaaatgcttgctcaataactttctcaagaatgagattgcgatctgcgaatttttgctggaaggctaccatttcctcaacctcgtcggtggtgaatattccaaggtatgcctcagtgatcagacgggaaacgaaatcttcggtgatcccaaggtctgctgcattgatccctacagcatcaaggccgagcacttgtgggattttttcagcacgacgcagaagttcgtttttgatgatgtcgaaagattctggtttaagactcatttgcctctcctcttgattcggtaaggtgtttccgggtccatcccggctttaaacaccagatatcgtgtcaggatgtcctgacacatgtcacttgttgctttgaaggatatgaggaaggttccgtcctcggtgaatacctccacccaatccccatagtggacaacgaagtctcctgtggggcatctcttcattaagcaatatccagcacgaagtctttgatgacgttccagtcatcgctctcaagatcgagagagacgcgaagctcttcagattggtcataaggtgtcttgaacttgatcttaatcacctctggcccaaactggttcaggaactcattacggtcatcaatgatgacatcaatcttaataccagctttgttttttgttgcataaaaaccgtgaccacttccaggttcaatgctgaaaaactcctctgtctctcgtttcaggaatcttaccttggacgagaaatggcctttcttgcagtaagacacgaaatggttgaagtgtccagcagccgcccaacctgcaactgcatcaacagccccggcgcggggacgcagtttgtcgtacaggtacggatcttcccaaaactcatacggaggtaactgattaaccttcgcaggagggaagtattttgacagattataataatccatcccctgcgggtttatatccggcaggttataatctgcctttacaccgtatacctgctccatccattgaagccagggtgtgcctgaatctacgaacgttaggtctacatcaataccgatgttaagtggcttacgcattctcttctccatagctgattgatctcgcccactcaaggacagattcggcgcagtcagtcaacttaccctctttgttatcgaagtctttttcatgacctcgaataccgtcaaggtataaccagttcctgctgtcgttaccccaatcatagcctttccggtgaatacgtgcaaggaaaaactcaccaccagttgcataagcgtgatcagaaagctctcggatttcttccgggaaaccaccatcagaaaaaacaataacctcatcgttcgcataattctgcttcagtttttcaaccgctgccttgccaaacgcagacttgccgaagagtggtttgatcaccttctcagagcagtgaatcatccactgacgaggagatacattcacaccatcaatcatcaggtagggactggggacctccttgtaacgacgagtgtacatagcatcccacaggtcgcgagagatgccagcagtccttacagccacttcaaacagaagttccttaacttcctcgtggtgcaggtttgggtgaccatcgcacagataggtggagatgtcatctttaccgctcaacggcggtgcattcagaacgataatatccatcagtaccccgcatattcttgcatagcgttaacgatgtccagacaggccccgatcttattaaagcgctcttcatcagattccgattcaaccaactcctccagacgcatgtcaagatcacgaagctgctttatcaaccagtcattatcaaacgagtcagggactttgatgctgataactctactcattcttctctcctttgcaaaagggccgaagcccttaaatgatattcacaagcgtgttagccatctcttccttggtacggatgttgcgacggtcacgcataacagaaccacagcattcacagcgatatgcctggaattttgacaggtaggttgtccccaccttaccttccataggcagtaccttatcagagttacaacgaacgcagcgaaggacagtgttgtcgtcttcttcgttataaagcgtcacgttcgggtgtttcttcatgaaaggtctaactttcaagtagataccttcaagtgtcggaatatccccgatgttgtaaaactccatttcttcgaatgctgcaacctcaccgtggaagcaacgaatccacaaggtgatcccttcgtgatggcgcttacgggcatcaagctcgaagtaattacacgcggcctccagagcgttggacggcagggagaaagccgacttcagttctgcaagtgtatcgatcacgatgtacggtgacggcggtttcataccgtggaaagcaaaccgttggttagcccatcctttgtcgaaacgtgcgttgtgtgcaatgaaaatatcacactcatcaaggatatgccacagttcttcaaccagttcacggtcgtcgtggatatcggttttgaacgtctcataatccggcagcttgcgactgataatcgcagggttatccaaccacttacccgcccatgtgtacatataaggctcatgttctacgtgggaaggtgttacaaacgccttgaatcggttaaagacccaagcgagcgttggtgatacctctacgtcaccaaggaagatcttcgcgcccggattgcgaacaactgtctcggtgatcacctgagcagcctctgcatcatactggtgcgccttcaggatcagacggatatgagattccttactctctttccccagataacgacgagcaatttcacggttgctcatacctttcgcttttaattcaaggatttcttctgcactcagcattacacctctcggataaattcaacaatatcattcacagcaaagtcacggatggcatctttctcaacatcgtatgctttgatcatccactgcggctctttgtgatactctgtggaaccgaaccacataatcgggtccatcacggttcgataaccgtattcaccccgccagttcttgtaatagaacttcaggggcttgctcaaattgtccagcaaatctttcctccgtttgtctgacaaactctgtaaggtaaagcgttatgctatcatgcttctgagtacctttggggatgatcaggccgaggtcagtctccgccctttcaatgatcttgtcattggtacatctcctcaagaacttcagcatatcgtctttgtacgcagcatggatagggaacccgctaaaatcctgttccaaatagtcagcaagatttcggagcgctgtggacaaagacgtatctgtgtacgcagacacgtacttcatccatgccttcagcacatatccttcgaaggtgttcacacactgactcaagactccacgacatttaccatcgaagtggtcatggtccaagcaaggtttgcgaagtggctccccaagcacaggatcaagacccccctgctcaaggattaatttctccctgaatgcagcgatttgtcttgcatcttttacccaaagtcctggcgtcaatggcactacgacaggtttcttccttgccttgggttttgatgcaggactccttaccctttttctacggatactccctccatgaacttcttcccgatcaaatacgcatccgcataatccgccttaccagccgcgagcgtaagaccgtctaaccagccaggcatgtcgcactcaacagccctgaccatatgcgatttttccatcttcacttggcccgttgagtataccttcttacctgtctttttgtcaaccttttctttcacaaaagtgcgctcttcttccggtaaaagacctcttgcaaaagatttcacagatgttggtgcaacagtgtggattgaaccataccctaaaataccaaactggtacaatgcgtacacaatgcagtaaaaaaggccagccaaatcacgagttgcactaccgatagaaccaagactgagggcttccatgacgtagtggtcaattctgtgctcctctgccaaggttgttatcttgttcacaatataacggatttgctcataaacgttgtcaaaataaacaacatccttctgcctcttccctttactgtgtgttgagcctgtcctgatcatttccctgtaaacgggaactccatgttcccatattacgacagcacagtgacttaggctttggtcaaccgacatcaacttcatcggagtctcctacagcttggtccttgaacaacaccagagaacactcaaggtctccataagccacgcttgtcaggagaactaatctctccccctccacaagctcacaatcctccagaagaagcacagtgaatgccttatcagggtcaaggaagtcatccgtgaagacaacatagtccccatcatctgtttccagcattctccacagccctgttccaaccatgaattttggcttcagagaggacacggagagggcctgggtgtccctcattacagcatccatgatcatcttatcaatcatataacccccacgcgacgaagttcagttgtgagcgtagtatggtcgttggcagttcgcttcatgtaaaccatctggaagatgattgaagcccattgccctgcggtcatcttgcgctgtaaaccatcccaagaggtgaactcaaccccattagggaaccaagtcttgtactggtcaacgattgccgtccacatttccttctcgttctgaagatgcccgatcaggttgaatgcagcagtatctccaaaacgcccagagatatcgaagcattgataaggcttgatattgtctgaactgtccccgcaaagcatctggtagccaaagaacttacgtccccatcccttgaccttgtttccttccatccagatctcacccatagaatcgtcgataatcatcgggatcgggtgtttccagtttttctcctcgctatcacgcatcgtatcaagaagtaaacccggtgttcctttctggtccttgtcgaacgacgcaaccatgtagttgaacttaccagtcgcctggaagtgttcccatccggtatacatcagaacagacaggtaatcatctgcctcaacaccatcaatgaccttggcattatacttcttcttgacatactcgcgggtttccttcaacagcaaaggacgaagggtgtcttcacggtttcctttgtaacgttccggtgctggtaacaacagacggaagttgttgtccccgccgagcacaccaaggccattgctgctgtccattcccaaatgttcaaagatagcattaatctttgtcttcaggatatgcaggcagtgttccactggttcaggggtttgaatatcttcgattaagaagtcatctcttccccaaggggtgaactcacggccttcagctttcgccttcacttccatattggcgttctggtccttcaaccatccgccaaccaccttcttggtggaaccccagaactctgttctgtttttaaagatctttgaccgaccagaagcgatgtgagttgccttaattgtacgcttctcagcgccagcggcagacacaaagcaagtctggtcaaggtctaaagcgatcacacagtcattcgtgactttatttttccaatctttatcatacggatatcccactagccctctcaatcgttactcaaatactcgtccaaataccggacatccaattcccatttttcccgtttactgcgttcgtgatataaagcgaaagcctctttcacgtactgttctgcaatttgtctggagacaccattgaccttcatgaagtgacgaagagcgatttcccccctaccacgaatacccgccaaaccaatatgtttgacttcgtggcaggatggacaaagtgcgatcagaccttttagcgtgatcttgccattgccaaagtcccagatttcgtgacactctacggggtgtttggttccttttcccccgcaaatctcacatttataattggcttttgcataacatttcttccttacgacatcccaattggacttagagaggtgagagcgtaagttagtgaaccaagctgttttaggaaccagttcaatctctaatttcaatgcacctccatagtgtcaattactcggtcaatcgctttgtgccagcaatttccgagaaggttaagacctttccagttggttgggtcctctactcctgggtcgttctcagccatcttgattccccagattgcatcgtagggagatgcctcaacaaagaccctgccttctttacgaagcttgatagccgcatccttaatggtgggattagccatcatcttggcataaagaccattcacaacgatattttcacgaaacgcttcccatttgctgttgtcgaagttcttcacccgccgaccaagtttcttagcctcttgggggtgataaacattagcaatatcaaccgcgatatttgtatcgccaaacagcatagccttttcatacatcatgaagtgttctacagtccagaactttgcaccaaccgcttggtgctttggaatccagaaaggattggcacagcgataatgattactgaagatatcgtattgggtgaaaaagaaaacaaacttatccgttactctcatttctgcccctccatgtcatgaacccggtaatacccagaacccataagaatccaacccttaaagcccatccggggatttccaacaccggggccgtccatgtgaaaaatgcgaacaggagggtgccagtataccaccccaacaacatcgtaaaagcataaaacagaagcagaccaaagaactttttcataaaatcacctcagtggaatgtctttttggaaggacaagaaccagcgccatccttaacaaaggattctgtgcgattaccatcactgtaaatgcagactttggagcttccatcggtgtattcgtccaccaaggtgagggtgttgactgtggcgaatgccggggaagagagcagtaatactgctatgaagaattttactcggatcattttgtatctcctttttatatgttgagacccgatgataatcatcaccgggccttttgtcaactgttacttacctgctggcagagtaacgaacggggcttgtgctccactggtcatatataccggggtaacgccattccacttgttaatggcttccagttgcatgatctccgggtttttacgcagagcatcaccacgcatctgaatggattctgcttcaccttttgccagtgccactttagcatcggcctcgccctgagcttgcagacgcttagattcagcttcgccgcgagcggcttcgatctgtttctgagcttcagccttggtctgctggatttcgttctcacgcagcagagctttctgagttgcttcgatcttcgcgttgattgacgctgttacctgcggtgggtaaatcaggtcatcggtatatgacagttttacaatcacaataccaatcggatcaagcttggacttaagctgcttggtaacacgttcaagcaactgactcttaccatcaccagccagcgtaccaatgtccattgagccagcttctttgatcaaggcatccgagatattctgtcgaatgtttacatcagtgatttcctgaacacctttgcggtaggtctggaaaatcttcgtgaccttggagcgatcaacaaagtattcaacaccgattttagcggataccgtcatcgaatccttggtctggaagttgaacggctgctcgtagttattcaactggttgaatgtcgggaactgataaatctcttcgttccaggtcaaccaatacttaccaacaccaacttcttgctgctggacacccttttcgtcaccatacaggtcaacctttacgccaacgtaacccgcaggcacggtggcacgttcgcaaccagtcaggccaattgcacccagagcgatcaggccagcaaacagtacacgtttgatattcttaagcattagtttggttctcctctttgattttgtattcagtttttacgttttcgtcaacgtactcatcaacaatctttgctacgtaagaagcagcagacttattcttggaacgggccagagcctgcaacttttcccacgtagacgctttaagatttagcagcattaacccctccacgtttaataaacacctttcggagccagtaccatacaacaactggggcggagaatacaagggcgaaaccgcccatgactaaaagtgtatcctttgctgaaaccagagtcggtactgcgaacccgaagatgaagcacaagaaaacaaaaagtccaacaccattcaggtaatatttcattagttgctcccgcgaccaaacagaatatcagcttcggtcatctgctcaacctgctcttcgagatctttacgctttttacctgcctgatactggcggtcaaattcagcattgatcagggtcttgatgaacttcgggtcgtagttatggctgtctttctcaaccgcaacgatgtctttgaactggctcgccgcatctttttgggcgatcttcgcatcaacaccttcctgaacaacttttttcaggcgctcacgctctacagcgtcagaaggcagggtgtttttcagttctactttgattttaggcatacgtggcatagttttgtttctcctctgtttgtttagtcagttcagtatagctatttaaatctttttgtcaaacacttttattcgataccgataatctttccgccagctttctcgatttgctctacatacgtcttcagattttcgagagtgcattcataagcgtacttcttgacaccgccccaacgacgcttcattgtgaagcggatcatatattgcttcggcctgaatgtcggcctgttgccgataacgatttgaacattaagacgttttgacaattctaacagttccttgcaaacttcgtcaaaatctttttccaatttatttctcctctctgtcttgatggggtccattatatagaccccctctttattgtcaagcgataattttcggttctacgaaagtggttggcttcatgatcttgcctttactatcgaagaacacaatatgttcaccactacgcacagcagttacagagttgtaacgtcctttggagcgtatttcaatctccttgcattcagcagtcagcaactcgtcatcagtgtacagatgaagggttggatgaacatcgcgaagttgtgcgattgtagggtacttagaatcgtttgacgtaagcacttggcgcatattgtagtccaagttaatatctaatcgatagcataacgctacagaccgctcaagaacagcacgaacagattcaatggataatggtgtattgaaaatgagttctaccatctcaccaatgttgaactgtaccatcccatcaggcttcattgctttttcccaacgaataccagaagattcaagcaaccagaaagcataggacgagacgacaaagagatcgcaagcaccatctacaacctcgatacgattgccatcttcaagagccttaacaagctctttgaattcttcttcaacgaaagagaattgcaaatcaatcggagtagccttaccgccgcgagcgacacgagcaatatggttccattgggctacatgacgaccatattcaacaaggtctttcggttttgtcattgacagtagggtttcataagttacgccgaagttcatttattctccttaattaacaacatctgaagcatgatcaccatcaggctgatcacgaataattcttaatggcagcagcgctccgttctttgctacgaacaggcatttatctccatacgtcccattcttataccaagagtaagacgtgtttaccttgtaggccataccgtcgaactgacaggtcatggtgttccacaacggtttggtaagggccagcgttaccaggcccagaacaaccgcccagattaacaacaggcgtttgaccttaccttcaatccaatccaggaagtcatcgagcttatccttccggagacggtaggcgagataaatcccgcccccggtaaccagtgttgcgcccagcagcgccagccaataccagatcattatgcacgtacctcgattactttaactgtggtatcaccacgaaccgggacgtttgagccatcatcaagctcaaggatcatatcgtcacctctggttttcacacctttgacaacatatcctttgccccacatttcaaccttgtcacccattacgacattctttgccttgtaatcaccaggcagacggtcttcatctgtgactggttcatacaggtcgctaaaatcctgtggtgacattgcacggaattggtcgccaaccttaacgatataatcaccaggaaaagcttgggtcccattcacatccatgttacggatgtctcgtgtgtgaatctctgagtctttccagacaccagtctccatccactttgtcacttgaccaacacctgtgctcgaaccattgaacacatgtgcttccacttcttgaggttttctcttataaaatgccatcagtatacaggctcccatgttaatgaatcaacttctcgtacactctgccctacagggaactgaggaacaccgtcgtcagtccttgcttggaatgtgaagttgatgaacttaccgaccagaagtaacattctcgcttgagaacgttcttcacgcgtccccttcatcttacagttaaatctggttccgtctttttcttcgcagaggagaacgccctcaccgtttttgtcctccacagagtccaacaccttcgcttcaccatcctggaacagcttccatttctgaaggtcggaagatcgctgaccgaattcatacacgcctttgaagttgcggataataacaccttcataaccctcttgcatgtatcgcccaatgaaccgcttaaccgcatcttcattcaggacaaactcaccacgaacaacatttatttttggtgcattgacctcacaatcaagtgaatacatcacgctaacaagatcagatagtcggtttttatcatggctctctgaatgccacgggctgtttgcgtttacaggaatatcgaaaatgtgatattcaaggtccaaacttgagtaaccgccatatcggtcaacatctttcaccggttcaatacttacatcgtattcatcaccatcaaaatctttccatacttgctcaccgttgtcaatagctttctgatagcgtttcagatctgattggtaatccttttcaatctcaacctcgatctgctcaggtgtacgccacttcttagccagagcaacaatcttctgtaagctcagaccatgaatatatagttcaccatcaaatttgtcaaacccagtatgctctgcaagttcttttgtctgctgcaacaatgcaccttgaacagggtacgtcttgtttccgcgactattaaatactgggataccatctttgtcaagagttacaagggcgcgtaccccatcaagcttaggctgcacataagcagggtaaactaatgcttttgaacgtttaattgcatcgtgtgcgagcatgggagagaagttctcctcagtctgtaacgcctcttttgtctcacgataaccaaggcgtacttgcttctcccattttgatcgcgcttcaagcacagcctgaaatgcagcagttgtttgattagcacgaccaacatttttcatttcacatttggtacgtttttgctgtacctttccattttctttaccaaactcaacaactacctcatcgccctctgttctaacattccagacctgataagatccgtccttgttaatggcgtacagtgttggggtatctaaagcaatcgacattatttctccttaccttgtaatgctgtcttacattcaagatgatcttccacaatcttgatgaaattgttgttgctgaaagcctctacagcaccacaacggaattgcataacaccatgagcatcatactgctcttgctcaagatagttgatacgtgggtttaccacaagcacctttgttcctctacgaacagcaggaaacaactcccagttgaagttgatgactgtatttgagcatccgacaacgatcaccatatcttcattggtaagggtgtcaaggatgtcatacatcctgctgtattctggtgcaaattcaccaaagaacacaacattgggcttacaccatttatactgatcaggatcaacctcgttatagcctacatcaataatctccggctttcctttcgggttgtccttgacaatgatttccttcaggtatccatgaatgtagaccgtatcctctttcggcacaccagcacgttccaaaagatcatcaacgttggtggtcaagttaacaacctgccctggataacgctggaaccactctgcaacgcgaaggtgagccaggttcggatgaacagtcggcagttcagcacgacgcttattgtaaaacatgtgggttttatggtagaagtttccacggaatgcgtggatattgcaaacctcttccagatcgtattcatcccacaacgccttacctgttgactcatcagtacggaaagttcgaacaccactctcagcagagaaaccagcaccagaaataacaatcaaacgtctcacttatttctcctattgtaatttcaacgagttacgcagacgacgctcttgagcatctcgtgtttcctgcggaacgctgtgaatagaatcgttaccatgacggttttcaaccaccaagctaactacttgatatccataatcattagccaagtcaaggtacggtttaatttctttctcgctggttgaggtatttgaaacgatcacgcgatcataaccgatatccattgccaggcgaacgtttttctggcaccactcgtgcgccttgtgctggttttcctgcttccaccggtactcaccatcaacatagtggaacatatccgcttcgtaatgtggaacattgctgtcattcttcaggagttctgcaacggttgatttacccgcaccagaaaccccacgaaggatgattaatgtcttttccataccctctcctcagtaattgtttctcagaatggttacaccataccgtgccaaactatcttttgcaagcataaacttatgccctgctgaagggtttgaagtatgtacgaaaactttaacaggcccaaacaacatctttccgaagacaatcttttcctcaagggcaaggaaacaccaataaccatcgtgttcagactcttcgcctaaatcgttatcgaagtgccactccgtgacacgacgatatggttttgaccgattttcgagaaactgaataaaatcctgcgaattttttatccacaaggcatctggatgcccgtaattaacggggtcccttaagtcatcgagccacaccaacataaaaacgactcccacggtcaaagagatcttctatcgtaaaataatcttcaactatcttacgacgctgctgtgaatccatagctgaccaagcatctttggtgtagtattcacgaatatggtcaagcaattcgtaatactcttcatcaatacgctgctttgcgttgtctggatgatcccagatcatatcccacttgttatcaccaccacgcatcaagaacttcttcgccagataatgaggggatttgattttcaacagtaagctgaacggatagtttggctcacgcacaacataaccttcgtggttgcaatgctttgacatttcaacaacatctgaaaatttaaccatctggtgaacttcaggacgcttgaatttagtaacattcgcgattccgtcaagagcaccttcaggcagcataaaacttgtgccgtcacggttctggattcgagcaccaatcaggtacgccccaggctcttcatcaacaatatgcggatcagatggatcacagatttcgaagatgaacgtcgcctttgcactttctgtccacttaatgaagtgctcaatgtcattgcattcagcaatgatgtgattcttcgccagaactgcaaagtctgattccagagttcctgtagttgacaccacaagctggcccttatacacaccagcggatgccataaatccattaactttacgaactgcatcaaccaccttgtctgccggaaggtctgtgccattttcgaagtgattgaaaatcttggtgaaaggccagataaccacattgtcatccgaatcaaccaccatgccacggcattccaggagacgtggatctgtgttccacagattatcccagaagacattgtttttgtacttcagaactgataggccagcgaacgggccatcagtgtaagtcttcttggtgaccagctttttagcgaccagatcgtctacgttaaagagcatgtttcttctcccattaggatgtcatattcaatttttgcaataatatcttgcagcttttgtcttattctaacatcctgttctgagattgcaagagattttgcatgatttctcttttcaatttgccaagctttatgagcatcggtttctgttctgaaactaccaatataccttcctttgtagtggcagtaaaatgtgtccgcaaggcgggtttctttggaaacccctatcatatacttgccatttttcttaacagatgaaaagaattgattacattcttgtgttacgaatgcacaagactctggtgagtatatttttccgtcaccgaggatatccttatccaagtagaggccagcaacatccgtatcaccaacccacgaaatgaaattggaaaggtaataccattcatcgcatactgatacactttcataatattggtgtttattgtgctttacaagacatcttcgcaacatatttcgccacttaagatatacaggatggaaaatcctttttccatcaacaaccctctgtgtaattatatcagagtcattgataccaagaggggagctaagatcttttttcataaccatctgcctgataatacgttgtattatacggtgtctcaacactgaagcttacctggcataattcctgagccaagtatgtcccaagttcaacagccatgtcaagaatttcatgttctggtcgctcaaaacgaggatactgcatgatacgcacagtcataccgtcttccacaccaccagtataaacataagtacaaggggaaatctgcacacatgctcccctcatcacccagtgtcggcaaagattttccgcctggttgtaactgccagcaatatgtattgtggcgtaaaaagattttgatgttttcttaggcaagaaattgcgtttttggttgtgcataccatctcctcagtgatgaatatcgtaaataggctttttaaggcactcagaaacggcctcaagcatcgtcaaaggacgaccgtggacatcccaacccacatcaaggattcgtccaccaggtgccttatatgagccgtggctatgtccgtggagcatgactgatccgtggtgtgctttattccaagatgcaaacgggtagtgcgacatacacacccgaactttttcttttcctgtgctgaaatcaatttctttatagtcaacaacttcgtgaccaaactcgcgaaatacccgctttgtcgtgtggttgtcgtggttgccaccaaccaaaatgatctttccgttgattcggctaagaatgtcacgaaccttcggctccacatgcttaccatacgcgatcacaaaatcacctaaatgtgcaacaacatcatcaggtttcacatgtttgttccatgttttaaccatgtcgtcattcatcttgacaacactcgctgaatcttctttcggtccgtacaggtttttacggaacttatcacaggatgggaaaccaagaatattggtatgccaccaatgtgtatctgatgttacatgatcgatattagtcatttctttttcttccttttcgttgttttcttatacagccctaaagcggcgttctcttgggcgcacgtcataacctctgtgagtccacgcctttccagttcaggcatgtttagttcccaccaccccagccagtaaatttcatcttttgtaagtggttctgcgttaggatctgcctcttgatcgtgcaagcgttgaatggcttctttgatgatctcaacctttgtattgaaaacaaaagctgttgtatcgaatttttcccttacaggtttcttgatgtcttttttcatttgtccatgtcctccgcagggtatgcgtacagaaggtattggtttccacggggcagattgttgtgctgccaagtaataagcttcaagcacaccaagttgacgacatttcgatcaccatgaatgtacacacatgactccaaccacgacttaccaatatccacacggctgtcgagatacagttttgtattgaaccgcttttcagcgacagccatgatgttcttgagagccataaaagcctctctgcatacagatttttcaccagatatgtgactaagcttcaaaataatcctccacaatagccctcagagcctctgagcggccctgtattgaattaaaatggtgtgaggaacccaagtgtaccaccacaccaacaaaacgtctcagagaggctctcagagcgttatgagaatctcactcagatccaccacacaattattaccttcgatgtgctccactgtcaagtctttcatctgagtcaccaccacatttggtctgcgtagacgaccacgaacagagtcgtagtaatttccaaacacctcctgtgcagatttaccatctggtaacaccacacaaactttctgatccttattgcattcatgaaagacttcacgtaccatcatcaatcgtgtggtttcttcatctgtaggcatcgccttacgacgactcttaccacacaccatatctccaacagctttagcttgtttacttgacaacattaacactctcctctaaaacgataggagcattgtacatgaacaaaacgagaagtcaactcttgacaacagatttttgttcatccatactgacccaactgacccaactgagccactggctctatgactgtagaatatatagatcatacttaaagatcttttatatagatcttatgttttattgttttgattttaaaagatcataagttagtttaattgataggttagtattgtattcctttttgggaataattagacattcccgattgggaataattaggttgacatctgcgttacgttggtgtacattctaattatatctgttctggaataaataggagatggtggtggagataaagattggtgataacactgtgaacataagggatggctcttacgtcactatcccgacacagtggctttttgatgaccgtctctcaccacaagatttgcaaaggttgataaaattgtggtggaggtatgattacttcaagagtttaaaccctgatggtggtgatgaggtattctttccatctcaaaaatctttgtgtcatctttttgggttgagtgagaagtcacaaccgaaagtatcagagttcttgacaaagatagagtatcttggatacattcgccgcatacgctctggttttcaagattctaaagggaatgcaaaaccaaggcattacataattgttaatagatagaggatgttatgcttgaagttataaaatcgaaagagataagtgcttctgaaaaggttcttttgatgtttatggggttgaatggtgttggggtttatacttaccaagatttcataaactccacagggttgagtagagccactgttggtaggtcactctcttctctgtatgaaaagggttggatcgagaagaaaaccgccatctctgacagtggagcggagagtattcagtacagtatttcgtttggtgattctacaaatccaaaatttgaaagaacctgctacgtttatgttcaagagcttgcaggcccaggcttaacaatcggaaaagttggtatagcatttaatgttttcgaaagaatgcgccaacaatcaaagaaaagtttgtttcagcacaaactgatgtactccaagctgttcaaaagttatgctgaagctgccaaagttgagcagattgtgttgagtgcgatcccacaatttgtttgtgaaaaagattggttacctgacggcttcacagagacaatccacaagcaagatattttaaaggctattcaaataattgaggagaaataaaatgagtttagaacttcgtctgaacaacctgatagtccctgttgatcgccttacattcaagggtggtgaagaacaggttaagatcgatttaagttatgcaccaaaaggtcacattggttttgttgacatcacagcaaaaatcaagacatctgcggatgttatggctcttgctctgctggcagatgcttgctctcgacttgataacattgatattcatgcacagtatgtccttcacctgccgtacatcccctatgcgcgtcaagatcgtgttatgcaacctggcgaggcattgtccatcaaggtttttgcaaacatcgttaactcacttgggtttgataaggttatcgtagatgacccgcacagtgatgtttctgctgcacttctgaacaatgttcgtattcggcaccaacatgaacttgcagcatcctatagtgatgtacttgctggtagggatgttacgattatcgcaccagatgccggagcacgtaaaaaagcgcagaaggtttctgaacatctccgtcttccgcttgttgaagcaggtaaggtccgtgatgtaaaaactaacgagatcacaggtactgctgtcttcggggatgttactggtcgtgaatgtgtcatcgttgatgacatttgtgatggtggtcgcacattcatcgcccttgcacaagcgttgaaggagaatggtgcaaaacgtgttatcctttatgtaacacacggtattttctcattcggcaagcaggtcattcttgatggtggtgtagatgaaatttatgcatatcacgactggacagaaaacttctaaaatttcttgacatagtataaaacgggtgcaagaatgcacccacaaatttcacagaggagaaacaaacatgctgcataaagaaagcccgattactttcgctgatttttacaaaccgagtcacatctcgatgtatgacaaacgttctgaaattgttcaggacaatatgaccgcccgtaacgcaaagcactttatccacttcgcagacaatgaccaccgtgtgatgtttgctggtattcagggattcatcaagtggttcctgatcgatatgtttaatgaaaactttttcaaacgctcaaaggaagaagcgatttcagattataaagaaatttgcgaactgagtattggaccgggtatggtggaaatgtggggttttgagaagctacacgatcttggttatctacctctggaaatccgtgctttaccagaaggcactctggctccggtgcaggttccaatgttcactatccagaatacccatccggatttttactggttaccgaacttcctggaaagtgtgatgtcagcagaaacctggaaaacaatcacaactgcaacaacattctggcaatatcgtaaactgtctgagaaatgggctgctgaaacatgtgataataatctgcatgttcctttccagaaccactgttttgcatatcgtggtgaaggtgggacacatgacgcagcacagagtgaatttggtcaactgatcaactctatgggtactgacactatcccggcgattgtgtatgcgaaccgttattataacatgaagggtcgttttgtagctggttctatcccggcgtctgagcactccgttgcgaccacaaatattggtttcattgttggccgtctgcaaggtgaacaccctgaactgtctctggacgaggcgcgtttccttgctgaagtcgagttcctgaagcgttatatcacagaaatcttcccgaaaggttttgtttcctatgtggcagacagttatgatttctgggccattatcaccaaagctgcggcgatcctgaaacaggaaatccttgctcgtgacggtcgtgtagtgttccgccctgactcaggcattcctgagcacatcatcgcgggttatcgtaacctgggtgactttgatgactggtctgatgcacatactgcattgcaggaagattcaaattcagaagttgccaagattgaaggtaaatactaag

SEQ ID NO: 3 - DNA, 143792 bp, Artificial Sequence
  Bacteriophage San15
aaatttctcttgacatcgcgtgtgcgtgtgtgagaaaattaccgatccctaaaaaattttttcgctctatagaaaaaatacgttttcaaaactgaaaactcgatcgagaaccgcgcggaaaaattttttcgatagacagaaaaaatacgttttcgattttgaaaaaccgatcgagtacccagtgttatccagaaaaattttttcagcgataaagaaaaaatacgattttgaaatcgaaaacttgatcgagtactcggacttaaaacccaacaaaagggatttaacatttctggaattttgccacaattatcgtaccggggcatggaaattccattagtaatcattatgttgcatgggtggggtttgggataagttgctgtactttccaaaatcttaaatcacaataaaatggatttacaacccggctatgagggaaaaccatttcaaaaaccatttcgaatttcattttgatttccagttcaaaattccccgacaaatatcaagggcaaacaaatatcattttgaaaaaccgtaccgtttcaaaacaagttcttgaagagaaatatcaagtgatttcaggtcgttatcaaatatattctcagattcccatgcagcatgtgcctcttcctctgtgtcaaaatatcctatataccttccccttgggtcatttttagatctctgtgccttgaacttacaaagttttttgtcaaatgttacacctcttgcatgttttccatttcgagaaatataactgttcaaccacacagggatgtaaatacaagtatcagggccgtaagccttgttcccttctaccagcaaatctttgtcaagtgcatatccttgttgataattgttgcaccaccatgtatgaaagttcataaaataatgccacttatcgaccacaacaaccccatgataagaggggtatttaccgctgtagcatctgtttatcatattgtgccaatccttgtaggccgtatggtgatggagttttccatctttccgcatactcgtgataaacggtgcatcgtttatgccaacaccacatactaaactacgatgttttgtagatggtttcgattccatttccaaatctaaactcataccttcctcctaaatatcacacggttttcattttggtttctttccgaaagtctctctccacccacaaatatcatactctgcatggtgcgacattttatacatcaggatttcatcatcagttggattcatcacgtccatgaaaagatccttcatctctgagagcctgaagcgatagacctttttatccttcgtcaagataatatcaatgctcccattgacagcatctattcttaaggtatcatcaccgtcacataaacacagtgtcttaccgcaaagagtgatccagtcctgaacaccaacaaccatattgtttgcagtgctcccatgcagcataagctcaacaacaatagaacctgcgtaaccagttctctcttcctgaatgatgttgaaaacaaaaccacgctgaaacttattccaaccgcgagactcaagagcgctgtaaaggctggagtctgtgttaaattcccttaccgcttctcccgacagatacaaaaactcatccgagatttctgcacgacccatcttgttatcaacagacaaaatatctttactcagggtatctgcccgtttgccaacagagatcagggagtctgtgagagtaacgacaagcgcttccagttgggtgacataattcttatagtcataaagctctgaacccttcgctatatccttcagttcagaaagctcagactctacattcccgtgtcgtttgttaaactctgcctcatcatcttcatcagttgaaaattcaaggtaagatagctcgtgctctgtgcgctcaaatatcttgagtaactcggattcaagatccgggtgagggtattcgttctgtgtatgatcgagaatctctgtggtgtggaaaacggttgtcatcttaaaagctcctgtatcgctttgtgaggcgttttaataaatagctgtacgttcgcctaccctgtatggtaaaaaccccgcagaagcgttctggttgcgttaaaagcgggtattgagccagtagtctgtgaagtcatgccaaggaccgagattaagtttaaaactcgtcttatggtctgtggtaaactcaagattgtgttttggctgcaatgtatttatcaggtacggctcgcaaatgtggaggtctgcaaggttagagaaccacattaccttcaccctgttaatatctggaatcaaaccagccttcttgtgttgattgaggcgagcattgatgtctactgtcttcccgacatacaggcagttaccagaggcatcccaaaaactgtagatagcagcggggtaattcttcttcctatacggcttcctacctgctttaaggtgtgtccacctacagtcctcaaaaacaagaccaccataataaatatccacaagctttctcaggccaccatgaaccttaatcacagttaactccggtgatatttcttgcagtatccttttaacatcatcactttttaacgtcatattcctccaatggaaaagccccgtgctttacggggcattgtggtgtcagatcttactgaccgtgcttctggctcatctgatacttcatgtatgccatgttcattttatgctttacatcataggtgattggtaagtttccgaacatgaagtatctcaggtcatacatcttctcccagaacttgaaggtgtagtaagggatcttcatcaacgcacctccacaggctcaatgaagtagttctggccctgcttcgtctgacagaaagatcctgtgtaccaaacaccacccccaactaggcttgtcttacgcatgatgtcgaagttggtcaacttttcttcacgcagtagggctgctggtgcatcgaccagtttcattagtaagtcgaaaccagacatcgacatgatatacttgttgccatcgctgtcaacaatgtcaatgtttgcagcagaccgcccacggctgaatccggtatactggatttcaaggtgacggatctggtgttgttctgatctttcgacttttcgttcaataccgtaatcgttctcataccctgtataccatgccccggtgtctttgttatacagcgcggggtatttcctctttccgagcttcgccattcaatttctcctcatttttctctatcccaaggatcataccctggagttgttgtttcatggggatcaatacagggaaatcatcgatccagatatccggtatccaccccagctttgcacagacagcggccttttgcactccgccgcagtaaatgatgcctattccaagttcttcagcccagtatttgatatcatcgttcctgtcagtttcgaatcggaatgtcacgaacttgacagaccagtctgaatctcttgaacagaagaggtggacgaactgcgaccacctttccggatcaagagtgaatgtgtcatcgaaatcaagcgctatacgctttttctcaaatgatttcactcagcccccatcttctctacgatactgtcccacttattgcacttcttgtcaacataatgttcaagacgacgctggacggtttctgcgatctctttccgatcagaatcgcgagggtttatacagtcctgaagctcaagcatgtaagcgaggtcgattgcacagttgatcacatcggcaatctctgcgattgcaggttcatcacaacgataagggcgattcagtgctcgtgccagttctccaacttcctctaccagattcatcatgacagaaacagtagaccgggcttgcgcccggactgaggactggagtacgcgttcagcgattccggtcatttagactccttctcttttgccttctcagcttcagcggcttttgcagcagaatccagttcttcggtgtacttcttgatctgcgcatcaaggtacttgatggtgctgtcagccagttgctgagtacgtggtgattctaccacattctgaccgacatacgccgccagcattttgtaagctgtttctttctgaggcatgaagtttgcatatacaatccccaggaaacataccaccataccgaacacagcaatcttacgaggcccttttgtcaggtcgcgcttaggcacaggttggcgctctgcttcacgttgacgaggtgctgttacctcccccaaaacttcgaaacgcagccaaccagaagtatcaccattaggataacgtaccatcattgtaccatcattatcaatcctggtgacaactaacacatctccggctttataattggaccagtcctgattcaggacaaggttctgccccagaaagaatccaaaccgttccttcttaccatccgtctcttcgtaagtcttctgaattgcatacatgataacatatgcaaccgctgaaatgaagagcaggaagccccaaccgccgtaagtaccatcagtagtgagtacatcaatgaggtaaatcagaaaaggccatgacatcagttattctcctatttataaaaatttggcacaattgccgaacgaccatctttacaatcaacgcttgaggacagtgcctcaaaagccatgaaggaatcaatctgggtcttaccaccacagaactctatcgcccagtcatattctttggcgttatcccttttctctggcagataacaccctgttaaaagaatggataacaaaagtggtatgaagacttttttcatttctcattaagctccgcaatcagtgcctcagcacgtttgttgttgatgccattgatattagcaggttggcctgccatgtcaagacgatttcgcaaagtttctcctgcatcgtcttcacccatcgcccagaatggctccagaccaaggaaagaacaccagtatgcttttccccacgagtccaccgctttagggcagctatcgtctgtgtaggtccagtgtgcagcgccgtaacctgtcaggccatccatagtcaagtacaggcttggcatacaatcgcaactgtcatcaacatgacaagagcaacttgagctactggtcatcacacggtacttcggaaccagacgttgaatagaacgtttaatattaaccatttttcggcctccgcgccgccccggagtagatcgggtaaacaagtttgcccctgtcgccaatcggctccgttcacattgaacttccacacacatctgaagtgcttcgctatcgctccatcacttcctcttgaaaccaactatacactaacaaaaacataaatcaagtcttttataaaagatcttttgtttttagtttttaaagaccttatgtgtattaatttatatatgtattcatatgcaaattttgcaggacacgaggtgcaaattttgcatcacagcacggtgtattcgtatgtgctcatgcctctcctttccacagataagtagccgtgtgtgaccaagttttttatagaggtactgatggacctttcagaaacaccagtggcctcgcttatcgtcttgtaacttgcgaaatatttctttgattttgtctctaagtatccggctttgtattttatatgcagcaggacacgaagatctgtacaggacagattcttgtcatgtaactccttctcatcacaagctacccacctctcgctctttctggacaactgtaacctctccacaatagacagatgataaaaatccatcgacaatacctacagccttttcaaaatacttgctttcaaagcactctgtgccaccaggtatcctcaaatccatcattggaatctgccactttatcatcctttctaaatgccctgccaggcccccattctcaaaagtatacacaaattccattgtgaaaacactaccatattgagaaagttgcttttcccgttcactagggttttgcgtaatacctactttacaaacaccatcacaaaacctgccaatatacaaagacttatttttaccaccagggctatataagtaagcataatctgccatagtaactgttttattttctcgatccaaaagcaagaaacctctgctctccagatttctcaggcattgactgaacaacccccattccatcttagtatctaagaaaagaagttctacagggtaatttttaatatctctccgagaatcgaagcatctttttaccttgcaatagcaaagaacatcatccccagtcaatttttcatcctgagtcaagagatcaggtatacacatttgctttgaatttaacattttcattctcaccactccagataatctcttaagaattcaataacatacttcttcgcatattcttcatcagcatcattatgccacatgcgggtaattacacccgccatagtgtacaaagacctctcaaatggtgaaagtccaggtaaaatactaaccataaactcctcctctgtggtgatctccagaggatttaccgtgtaatctggtgggataatggtctcccactctcctcccttgaacttcttaaggctcaaggttctcctgttggaagttgtgaggtactcacaatgctcacaaccatcctttttgaagattattcgcacaattgccccggtgtacatgaaatccacatccacaccgagaccaacggcgacgattttattttgagtgctcatctaaatctaccgcccttccgaaaggtggatcaaacttcgcacggtttctaccgcaaaggacccacagtgtttcccatttacgaccccagtcttttttccgatgactgagatcctcaatatacccatcagtgaagattatcacatctgttgccttcggaatgttatcttcgatgtactggaatgccacacctgccatagtaccgcctgtggaggttacattgtagtccagcatctctttgatgttctcctgtgtgtacactttcacatcaccaaccttcgttgaccagcaaaataatgtcacacggaatgttttataaagcagacacaaaccaataatctcgttgaagatcttggtgagtgtcgtctgagatatagaacctgacacatcaaaaccgataacgatgtcgattgtatcctgttgcttccttcctggcaagatgatactttgcttgttggtgatagcaccgtagtttcttaacacttgcgtaacagaccccgatctacgagcaggtttacggaacgaaagatgcgatctcacacgagaaatcattcgttgtttgatgatctgcatgtaatcaatatgtggtttacgcattctggctaccagttctcgtgcctcttttggtccttcaccacccgcagcctttaatgcagcctcaataagacccgctgaccatgcaaagttctcatcttttgctaccggaccttgacacgggtgtggatcagtgtacccaagaatgtcacgatctgggtcataatccccgatatgagtacccattgggtgacctgaaacagccttccctttgtgaatggcgctgtaaatttcttccgccgtcatcccgtggaaagagaaatcacagtaacagtatgccataaatccgaattctttatttttatcaaagactgtttgcgccccaccagggaaaaatcgcataccctgagaacgtggtccaagatcgcttatcacaatatctgtgttgatatactgatccgcagcaatattgtacagttttgaatcgaagaacttaccacgagccatatgatcattggttatatggcgtgtctcatggatgagaataaccaccacttcccttggtgtctttttacgatagaatacattgatatattctttgtagtcatccttctgttcctgagtcatgtgggggtgtttatcaattcgagaaaacaccttcttcttccgctcttccggcatacccatgatgaactcagggttataatacaggttgcggtggtcagtcgccgcagtcggtaaccaacgccaatcagcgatgatcggcaaagaactcagcaaagtcccgtaaaatgggcgctgttgtaacaatgcaatacgtgcagattgaatgaccttcagagcatctttctgaagcttttcaatcatttcgctttcgtctttatacatatctctctccaaataaaaaaggccatcaatcaagatggcctcagtatatgtcatttttgaatgcggatcaactctttttcttcaacgaaataatctcttccttccaccctgaatccccatgccagttttggccttggctcatacggggttggtggaacagcaaacagtacaattgcatccacctttccagaatgggcttcgtcgataatcataaccccctcaccaactacaatcgcaggcttgaaaccatgatccagcatcttttgttcaggggccgttgctggtcggcccaagatgtgttcgtacattataccaccttgttcagcatcgcggtgatcttcggcagactgagacctgtctggatcatcaattgggtcattgctgtttccattttcttggatacaatgatgaaattatctttcgcaaagccaagtttaaggtcgaggatcaggattgacttgggttcacctgtcaacttctcccctgtcatcgagcaggtgttacggacatattttgccttgaactgtgcatatgtcacacttacattcatccctacatcagagaaggttttgcagtagtttgcatacgccagagctaccgctacgtcatccggcagttttgctggctccggtgctttttctacgacctcttccacagccttggttacttcctcagtaacttcgcccttgtgcatatgcttttctgcttcctggctcagtttctcttcgatagcaatcatctcgttctcctgttgtgggatatatttagttttcagcatttccatgtggtcttttgacatgttcagcatcattgcctgaacaatctcgcgatcaagcggttcaattatagtgattgcggtcttcttgtcaaccaaacaatctttcaattcgttggcacgacgcattacaacacagacgttgccacgcacataaccttttttatcgtcgatacgttcaactgaagggtattttgggttataacccgccacggttcccatatgaaacggcatgttggtgtagtcgcaagtacccataccgagtaacttcttacccatcatgaaccaatcatcgagggtgagtgagaactcgataccacgttttcttgtacgctcaatctttgtgtggtaacgctcttcgagatttttcatctcgttttgtgtaaattcttttttccagtcaatcatgttctactcctgggttgttcccgttcttgtggggtgaattatctggcattcattccgcgctgtcaacacttgatttcaaattctttacagtgtatgctttgtgtacttttgtttgaaggaaggataaaaatgaacaaattcaacgttgatgttagacaagtaaatgcccccaaggttacagcagatatcgactggagcttattaaaagatgaccagaccactcgcgccctgatcgagcactggcaaaaagagcacgagtaccgtcaaatggcaatgatgggtgtctgggatacgccaagaatgaataccgatgattttctttcagggttgaacccaagggtgatggaagacaatcccctggctgaactactcaagggcctgcttgaaagggtggataggagagaaggaccattttcttggttctggggttatgactgggatggttatcggcgggagagcctggataagaggtttttggcccgtctggaggtagatgtcagagacagggcctttaactcaagcccgttcgagcgggaagaggtctcaagagggaatgtctctgccattatccgggggcatggggatggggatgcctttacaaagagttctgcttggaggttttcaagtcgtacaagggagtttctcagtttgttgaagcccctgatcagacaaatggggcgttgtgaaccagaccttttaatcaatgcagagttccgcagatacggctttggttcaaaattcacgcagaggtcaagaaacgatattgatattcttgggatctccttgtctatcggagatcttcttgtattttgcgacttcaaggacagggataacttcgatgtgcagtgcaaccacattggtcacagcgtcttccacttgcgtgatcgcggcgttaagatcaagaatgcccgtgaagcgttgttgatttgcaataagaatgagacattattcaccttccgttgggatgaaagactcaaaaatatgatggcaggggaaacacccagcccggaagagttaatgatgatggaaatggctggatataaagatgagttctggcttgacaacattgatggttttgatacactcaagatcaaaccttttaatatgatggagcaacaaagatggtacgaactttcaattccacgattccagttttaaccccggcgcaagaacttgctctggctatcaagatcgcagcagagggccacctgaatcagaaagacaagggcggtaatccttatatccttcatcccctgaaggtaatgcactacctgaagactgatgattttcaactcatggcgattgctgtcctgcacgatgtgttggaagataccgatgtaacggctgctgatctggtcattctgggcttctccaaccgtgtggaagatgctgtggttcttctgacaaagacccccaatcaaacaccggaggaatatttccagggcattgcaagcaactatgatgctgttcgtgtgaaacttgcagacctacgccataactctgatgttcgtcgcctgaaaggtcttacagataaggatttgttgcgtgtccgtaaataccacggcatgtatcttcgtctgacaaagatgaaagaacatcatgaagcaattaacctgttgtcacaattatgaatctcttgacactgcttcgcacaaacaagtatactcagaaacagatgggcttcctgctggggatgccctcgtggagagtgagtaagctcgttctcaagttggagaaacgtggttacattcaggtaagtcgcagatacaaattgagcgggccggtgtcaagacccttttgtgtttacgatcaaaatctttacaaagtgactctatacaggagcaaagaatgtccagaaatcaagctacacccacaaaggcacagtcaaaaaaccccgcctcggctgggcgtggactgagaaacttcgcgaaacatctcgttactggatgtcttaccagcattcagagacaggaaaagccgtgaagtatcgtaaaactgacgggaaagtggtgggtggtgatgactaccttgaccttgaatccattaaggagctttgatatgaacaaatctttacaagaggctatcgagttaaggcgtagtaaagggcagagcgatgcggagattgtggactacctcttgaagcgctctgatcgcaaagaagaacaccttacctactataaaaatcgtgcctctgaactgaaatcagctttgattcaggcacagtttgaaagtggtcgtcgggtaaaagtcacggttgacaacatcatcagaacatgttggggaaattacttgtatcataaaaacacgcgttacgtttatgatggtaagttgaaggcatgggttaaagaccctagcaaaaacagtttgttacagcacaatatcaaacacctgccaggcaaatttcatgtggaggttattcttcctgacgaagaaatgccccggaaatgggagggggttgctgttggtaatctgtttggtaaacgcctgcttgcagtagaaaaagacgggatgtggatcaactctgatgatacattcattatcactaagaaggagaagaacaatgcgtaactggagaacccggtttgatttgcgtgatgtgtggggtcaacgtaatggtgagtgcggtccagaagagtggacagataagactgttcatgaacttgcaaaagagatcgcacgtcgaataaaacgtaagtttccacaacacatgattgatggacacgactgggaccctcgtttgacagaggttcaagacatgttcgaatcagtaccgactcttaaagagcaccgtgacatgctggcccgtctcattgcaaacgaaaatgtttgcgatgatgagatctgtgaaatatccaaagataccccgatggcgcagttcaacgaggcgatggacctgttttatgattggtgtgatagtagttctgtgtgggtggataagtgagagctttagatttttcagatgcggcagtcatgccgcttcctcgtcaccgcttgactcgtcgtgcatggtatgcagtctttggtgctcaaaagcttgagccagatgaaaaaatgttctctgaggatcttgcaacgaggattcataccctatacaatgatattgcccctgaagaaattgagggagtaattgcaaattatcttgaagaaaggagacaaacgaatgtcgagtcgtaatatttttgatgataaccggatcaccctacgtgacatcccggatttaatgcgcttctgtcagcgccgtgggcgctcgctgatgatgttcggtggtgctggcctagggaaaagtcaggcaatgaagcaggtcgcaaacatgctgtttggcgaacgtgacgacaacctgatcgatttccgtcttgcggataaagagccgtcagatgttgtgggcgtacagatcccggtcacagacgacaagggtgttacccggaccgtttatgcgatccctaacttctggcctgaagatcctaactggaaaggtatcgtgttcctggatgagcttcttcatgcggagccttaccttcagaaggttgcataccagatcatgctggatcaccgtattggcacctacatgttcccgaaaggagcggtgtttgcaggtgcaggcaaccgtcccggcgatggtactgcggtaagtatgctggaagcacctctggctaaccgtatgatcctggttgaactcgattacgacacgactgtttggctgcaagattatgccctgcacaacgatgttcaccacaacgttgttgcgtttatcggtgcaaacccaggtaaactggaaaactatgaggagatgttggaaatcaactccccttcatacgccacacctcgtacttgggttaccgcaagtgatatcctgtacgattatgatgcaggtatcttgtccacccgcctggcacgagccgctctacaaggatctatcggcaaagcattgaccgatgagttgtggtattatcacacccgtattgcaaatatggttcctatcgagggggttatggacggatcgatcaagaagcacaccgggtcagacacctcagatgtgttatggaccctcggctctcagggttcaatctggttgcgtaaggcaattcagaacaaagagtacacagatgatcaggttattgactttgctgcgaacttcttgcagtacatgtatgacaattttggtcagcatgatacgtcatcgaaccgtgatttcgtgagttctgtgtttatgtccttcatccaagagaactcttttggaaaagcaatcctgttgtcgggtgatcgtgagcgcttacctgccaaattgttgggtaaatacccggtagtaatgcagatcatcacagaataccgcaagaattttgctgaaggtgttgatgcaatcgtaaattaatcgttgacagccccaagtggggctgttattctttgctcacacaaacaaaagcgaggacaaactcaatgactaagttaaactggaaagaagcacagcaggctatgcgtgaaggtaaaaaggtacgcaaccaatactttactccagaggagttcttcgagatgaagaacgggcaaatcgtgtgcgaaatgggatacaacatggctggttggtatcttggcgaggcatggcaggatgagggatggagcgtgattgatgcgtagacctagcttcgggtatatttatatccttgataaagatggtgatgaacgttttgttcgtttaggctctcttgacatagaatatgtgaaggatcagtacggcccagacgcaaagaactgccacatccgtgaagacaatggtttttgtcaatcttcctggatggctggagagagtgctggggctatattagccaagatagcggagcacgacaaagaatatgttcactttgtcagggatttcgcacaacggaacagaattgttctcatgaagggggaactatggtaaaagagaaacttcgtccaattcctaattatgccgatgtgatggatgtacattcatgggattgctgtgtaaaatgcggtgccttcattcctgatgatggaaatgggtactggtgtcctgatgaaaattatgagtccgacatcagttgctggagtccacgtcctgaatgggcgacccacgtagcgtggtacaatcgctaatggcaaagttcaaatttccgctgaaagagatcaacgaggtttggtggattgatcgctttgacatggtgatggctggttacacataccagcgtcagcgtatttttgttgtctgtgctaagacgaaggctgaagctcgtgaaagcatggacgcttttaaagagaggagttgtgcatgaaagtaaaaatgaactgcaactacagcgaccgcttagaccatccccgtgctggagatgtcctcgatgttttggaagaggtttataacgggactttcattgaatattatcgttgtgaatggaaaggtggtgaccttgacgtttacccatacgagtgtgatgaggtgaagaaataacatgaaggagagtgaagaggcattgcaggcgcttaaatcttccttctcatatgaccctgagacaggtttgtttacgtgtataaaccctctcgctcgtcgtcattttggaaaggttgctgggacaaaaagaaaagacggttacgtaaggcttggtgttaaaattgaaggtaaaggtttttacttcttggcacacagggttgcttgggctttttattacggggtatggcccacttactttattgaccacaaggatcgacaaaaagataacaaccgcattacaaacctgagagatgtccagaaatttgtaaacgtttataattatagcaggggtaaaaagaaccaaacaggtttccgtggtgtattcgtagataaaaggtggacaagactcagataccatgccgtgtatagcaaaacccaccttggaacattcgactctgcggaggaagccagtgaatgttatcaagcatacgtaaaaacgattcatgacattgtagtggaggactgatgcttaagtataaagtaggtgacctgattgaggctgtgaaatctggggaggtcaatgtattcgcgcatggctgcaattgttattgcacgatgggaagcgggatcgctcctctaatcaaagaggcgttcccaaaaatgtacgctgccgacctgaaaactgagaagggcgacaagaccaagctgggaacctgtacagtggcctttttgaatgatgggtctctcgcaggatttaatctttactcacaatacggctataatcgtcgtaaacagggtctcagggacctcgattacaatgccctgtacgattcgatggttgaaatgaaaaagctcttacagagctatacagacggccctatggacatctatcgaatcgggttccctaaactaggtgctgggcttgcagggggtgactggaatgtcatcgaagcaatgatcaaatcaatcttccacgattgtgatgtaacggtgtatattttaccggagaaaaaatgatggtggaaattatctatcttttgatagcattcattggattctacatcttcattaagaggacgcagagagatttcgggagagtcgatagtgtagatctctttgctgctatatgcatgggcttgctctggcctgtgtacttcactaatcttgtggtgctgcgaattatcaacggagactggaaatgattgaactatttcctggaatgaaggtccatgctaaaagtgtggatgtatatgcaacagatggaactgtatttacatacagtgctcctcgtggcaaaaaaatatgcactcatcttgatgacagatgaagatcctagagatgatgttgacaatctcgtaaaggctaatgagtggattgaatcccttgggtggaaacacgagggggatgactgatggaagaaatttacgttatcattgatacccacaatgcaaccttctggaagtctgctaacgacaagacatcatggccttctgcgggaacagcgaagtctgcttttggttcaagtcgatacaatccgctgcgttgtctgtactcccagcaggaccgatttaagatcgcgaaggtaaccaccgcaggggtgatttatgagtaaggacagcgtttacgtcatctatgataaagaggatgactgcctgtggcaccataaagcaaagatcggttggataagttccggcgctgcaaaaaacgcctggaaccttggcaagaaaataaaatttgacaaccagaatcgttatgttgtagtctgtgttaacgaactgctggttaagtctttaattgaggagaagagaaatgacaatgagtaaatctgtagcaggtatcggtcagaccgaacaggaagcggtatacattggtggtaagcgttttgctggcgcacttaccaatgcccgtcctttttacggctttggtgacacgaaggatgttcggtgcatcaaaggcttttgttatcgtgatctgaaaaatcgcggcttcgacaatggcgatatccgaacctctgttgtaaaagaactgatcattcatgagcgtgacatctacgccatcacgatgaacagtgcttatcgactggacaacgtgtgcctgctggcattccttgcttccggtgtggcgtgatgacatccttaagctgcttgcagatgcaacgaaagatgcttatccggaagaaggggttctgtccgtagaggctaatctgacctatcgtgtgaccccagaatatttccaggaggccacaaaacgtttatctcccggcgaatgggttgtcacccaagcagattctgtgaagcgcaccctgaaagtcggtaacgaagtgtatgtggaggagaaataattgactaaagctatcaaatacccaagcactaaccagttccgtcaggtgatccgttctgtccacgaccgtcttacctttgacggtattgatgaaaacggctgcgtaaaacgcaaggttgttaacccgactgagtttctcctgccatacgtggggactgtgaagatccacgggaccaacgggagcattgtgttttactccgaagatgaagttgtgtttcagtccaaagaacgtgttctgtctcttgagcaggataacagcggcttcatggcgttcatggtgcgtaaagatactggagcactgctggaccaggtaaaacacatctgcgaaatcaacgaagtcccgttcgagttcccggttgaaatcgctggtgaatgggctggtcgcggtattcagaaaggtgtcgcagtcagtgaggttgagcagttctttgccatcttccgtgttgcaatcggtcagaaagaaacctcactgaaatggttgccaccaagcgcaatcttcggcatgggcctgccggaacagcggatcttcaacgtgctggatttcggttactggtacgtgcatatcccgttcaacgaaccggaaatggtacagaacgatctgacaacgctgaccttgcaggtggaagctcaatgccctgctggtaagttcttcggtgttgagggtgtcggtgaagggatcgtgtggtctccaaagagcattgaactggcacaagattccggtctgtggttcaaagtgaaaggcgagaaacattctgtctccaaggtcaagaccctggcagaagttgatccggtacgcctacagaatatccgtgagtttgtcgagtatgcggtcactgaaaaccgtctggagcagggtctgggtgaagtgggtctcgaccagaccaagatcggtgagttcatcggttgggttagccgtgacatcaacaaggaagaaggtgatgttctggaagcgaatgccctaaccatgaaggatgttgccaaatttatcagcaacaaatctcgtggttggtacatgcaaaaactgaacgaggggctgtaatggcccttatcgtatccacaacccgtgcggttaaagacaagcctttgaaggcgcagtgtgaaactttaatcttcgaggatgaagaacagggtagacaatatgtggaagaacatgctacctttgtcttctcagttcaaaaagcgaggattgtgaagaatggaaaaaccgaaacccaagtttgaggtgggacagaaagtaaaggatcttcttagcggcaggatactaagcataactagtcgctgttactttagtggttgggtatactctttcgattctgtgggtatgtatttgtacccagaggaagatctggaggctgtaaatgggactgcgtgagtggttaaatgtgaagagaagacaaatggaggataacgtggtaaactctataagtatcaatggcaataccatcatcaatggtaacgttgttggtggtgatatgaacattacttcccgtggtgataacatttacatcaacggcgagttagttcacaccacgcaagagaagaacatcactgtggttattcatggtgacaccaagggtatttccactgttgctggtgatgtcaatgtttacggcgtaaatgctggcaatatcaagacaacttctggtgatgttcatgttgagcacggcgcactgggggacgttaccacagtgtccggggatgtttatgcagaaaagatcgaaggtaatgtgaaaactgtctcaggcgacatctcccgccgttaattgatagcccctttcttggggctttttaatttggagcaagatttgaaaataaaagcaataatcctggcaaccgcctgtgcattttctctgactaccacaccagtcttagccaaagaaaacgcaaagaagcccaaggtgattcatctttgtaaaaaagatgatacagcggtaaacatcttggcatgtaatatgtatcgtgaagcccgtggtgaaagcgatcatggtcttatgtcaatagcttttgtgacgcttaaccgaaaagacaatgataagtttcctcggacggtgaagaagattgtctaccaaccggggcagttttcctggacatcctacagtacaagcttcaaagtgtatgagaaagatcgttgggaaaaggccaaggagttcgcagaggtattgaccaagatccacaacaataacaaaattgtttatgatgccattgacatcaccaagggatctacgtattatcattcaaagaaggttaagccttactggaccaaggcgatgattcgcacggtcagtattgataaccacatctactacaaagaaaagccggacccccagggagcctgaacttatgaagaatttttttgctgctttgtgtttgcattatcccgtatcttgtgatactgtctattactcaatggatgttctgggaacaagtgtcaggagcgtatcttcttggattactggcaggcatctacatagtgcggaaagctcgcaaaagaaaccccataaataactgcaaatagaggagagaaggatgataatccaacgtgccgaagagaaggtccaagtatccggtagtgtacagcgctatcaggctgggatcgcgattaatgctgagactttcagtattcttatcgacggtatttataacgacaaagttctggcggcggtgcgtgaaccgctgttcaacgctgttgactcacacacggaagctggttgccgtgataagccgattatcatccactccccaaccgacctggagccttggtactccgtccgggatggtggtttaggtatggacttcgacatggttacacagaccttcatgatgttggggacctccactaagcgtgactccaatgaattgattggggccaaaggcatcggctctaaggctccgttcaccgtgaccgacatgtttacggtcacctccgtcaaaaacggtatgaaaactgtttactcggtgcataagaatgagggtattccagaggttgttcctctgcacgagtcgaagactacagaggaaaatggcgttgaaatcaaattcaacgtagatccttctgagacttccaaatatcgccaggcaatcgtgaagtgcctgcggtatgcaaaattcccgtatgagatcaatgatccgtttgtgacctctgagatcaatgaccgaacctacccggttcagtatcgttatgaggacaaagaaacaggttggatgctggaaatgtacggttccgtatcccgcaatgcagacagcgtggttgtgatgggccagcaaccttatctgtcgaactatctgtccagtaataagaactggcctatgatgatggtttctattcctatcggggattgtgatgtgaaccctggtcgtgaatggaccatcgaaggtaagaatgaccgtggtttccgtgatcgcctcgaaaagtttgttactgaggctattgaaaaacgtggtcaggaagtcgtggaagagcttaagcagctacctacactgaaagaagtgctggagtatatgaagcgtgtcggtggctacttctcaacccgttacgggtcggggtttatcgcagacaagttccatgaccactttgggactttcagtattgacaagtgcataacttatggtgagaagggtactcgccgtgaaactgacaagacttacggttatgctgaccttatgaacggttcgccactggtttacaacgatgacggtaagtgcatccgcaccaaatgtaactggctgtctgagaactgcttcaaacgtgtctacgttacggaacgtattgaggcgctggagatcctgaaagacccgttcttcgttggaatggtgcataaactttccgaccttgagaagcgtcctgtcgtgaagggtgagaagaagtacggtggttatggcttgtacgaacctggtcacaaagtgtgggttatcgaccaagatggttctatcaagagcgaccgtatttctcgcgccgactttgatgatatcgaagccgccatgatctacagtggtggacaggtgaagggtaattgtgatcttggtgctgttcagtatctgcaccgtaaacaacagccagagactttcctgaaggacttgggggtcgagggcaagatgtatattgtgcctcttaatcgcagtggctggttacctgatgaaacaaggatcgttaccaaagatgacctttatgagcttgcaaaacagaatctcatggagtatcatctgaaccagcgaaccaattgctcatcaacttatcgccagttggtgaaggagcttggtatttttggggttaaagttgaaaccgaccctgagtataagcctaaagtgaacatgtcttattcgctttcgaacatcaagggatattacgctctggagaaaaaggctgaaaggattgtcaatgcacgtatgcgtattggtaaaaagcttttggaagttaaaaaatctcgatacccgctgctcaagtatgttgacctgaagcacttcaacacaccagagatgattgagtatcgacaacttattgatagcaaaggagaaactaaatgagtcagttattcgtatcccgtagcgcagcgcgtaagtttgcagcagacaacggcatgaaggtcgtggaccgtggtttgtctccggctgtactcgcaaccgggcgctggatggttgtaccaaaagacagccaaggggcatctaagcccccagaggtagatatgagtttcacctcggaagccaagcctgctcaggcttcacagttcttcgcaagccgtggtgatgcccgtgattttgcaaaagggaaaaagaatgcgaagatcattgatcatgcgaaaacatccgatggtcgtgataaacacgagggtgtggttaaagacctcggtaagcaggggaagcgctgggaagtcgtctttgacgttaccgatctgcatatcgaggccactgtaaccctgttgcctgaaccacacaaggttcctgtgactgtggttgttgaagagtccgagccgaagacgtacttcgacgaagagactgttgagaagaaagaccctgtggtcatcatgactcccggcaatgtttgcatctcgatgcctgatggtactcagcacaccatcaaccgtgacaacgatatcttccctgatgtgggtctactgctgattgagggtgatatcgaaggggctatcgcgctgatcgaagcaggtaaagaagccaaggctgaaaaggttgtcgatctcggccctgaccttaaattgctggatggcgttctgtactggcacggtcagaaacaggaaagcaccctggctgatcgcattcttaacgacattaagaatgatacgttcgatgaccgttatgttaagttcatgcagaagctgatgcacaacccgtcttatgcgtctgtgaaaatgctgtatgactttattcagcacaacgatcttgagattcttgagaacggtgatgtgaaggcatataaaaagatcaccatcacaaccgatggacctcgcgatagctacacaagaaaggttcctaactataaagggcaaatcatttccatgcctcgaaacatggtggaagataaccctaaccaaacttgtagccagggtctgcatatcgcctctctagagtatgctggtgggttcggtggcaacggactgattgaggttgcggttaaccctgctgatgtggtcagtgtaccttacgactacaaccaacagaagtgtcgttgctgccgttatgaagtcctgacaggtgcagaaaaacccgttggtgcgccggatgtgctggttatcgggacgatgggggaaattctggaagagatttacctggaagaagaaactaaggaggattgatgtcagattttggtgtgggcgttgaagctgcccttggtgctgtcatgtcgggggataacgtattcgttacgggacccggtggtagcggcaaaagttacaccataaagaccatccaatcgctctacgcaggttcagtcctcacagtagcccctacgggggctgctgccattaacgtcaatgggatgactgcacaccgtgcgtttgggcttacaatgggggttgctaccaaaaaggatactgaagagattaagccgaaagtgaaacggctattgaagagtaaagcgctaaagatcatcatcattgatgagatcagtatgttcagggctgataagttgtgggaaatggatatgaaatgccgactcgcaagaaagcaaccaaataagccgtttggtggtttgcagatctgcatgtttggtgacttcttccagaacccgcccgtccttaccgagacagaaaaggagacgtatttccagttccattacacagaattggcttgtttctcagatacttggaaggaactcaatccttatccaatactacttgaaaaagtttatcgccagagcagtgtccatttctcaacgatgcttaattgtctgcgtcgtggacagcggattccagaaattgttaaattcatgaacacgcattgttatgatcatggcaagcctcttgatgccataacgatcacatctacaaatgctgctgcggataaagtaaacaagaagcgttttgatgaggtccctgggttgcctacgttgtacactgcgaagaaatctggtgagtttactcaaaaacctgttcctgaagagctttacctgaaggaaggagcacaggtaatgattacagtaaacgaccctaaaggctttgatgagccagagtatgtcaatggttcccgtggagagataatcgaactcggtaaggatagtgtgaaggttcgtttggactgtgggaaagtagttgatgtagatgcctatgtgtgggagaatgtggaatataacccaatcaaggtcaggaattctgatggtacaacaaccgaagagattgagaagatcactatcggtgaataccgtgctctccctatccgtttgggctgggctgtcacaattcataaagcgcagggcttgactttacctgaacttaatatagactttggttatggcgcttttgcacccggtatggcttatgttgctttcagcagggctacatcagctaaaggattaagactattgaaaaaggtcaaagaaaaggatattattgttgaccaacgtatagtaagattttatgaagagactttcccaggtaaataggagataaaattatggcatcatactctcgaaatgagttagtcaagaagttccaaaaggaacttgaagattggaacaacgccccagccgcaagtgcgttgaagccaccgaaggatactacacatatccaaatggcctctcttgatgagatgatgtcagcatacggctacgttcctcgtcgtgttccacaatatccgaacattacagatggtcgttttggttaccagtccctttctggtaatgattttatctccctggaagatgcggtgtcataccacaataatgcaatgttccgtggtaaccctttcagaaagattcctgatcgtttaagcttcgctcttcaaaaccgtattgtggagcaggtgtctgtacagcgtgataaatcccgctatgcaggtggttcaggtattaaatctcaaaaattatgggtgaaattttatgacatttgaagttgaagatttttctgatctgaagaaagtttcaacagaaaaactgttgaaacttcgagatgtggctaatgataattataacgaggcgcatcgtcacatgacaaaagccttgttgcatttgtggtcaattaaagacgaactggagttgcgtaaaaatgctgaaaaaactatttaactggctgtttgcaagaaggaagaacctcatcgtgaagttaatgtgttcgatttcacaaaacgtgaagcagggcatgatattactcttcgcatgattgatgatggggagtatgcagaggcaatggttttccttgctattgatcaacaggcaccgggggttggcgactttattgttgtcaatcttgaacaatcctctatgcagggagaggttgattaccacatgacttttgtggttgagtctgtgacttgtattgcactgggtatttcccagctaaccctaacccgctacgaaggtgcagaagatgagtaagtcccgtaaagtcgagattgaatttgagtacaagcacccaaccgaaggtgtggttgcagtagaagcactttatactgttcagaagccggacttttacagcaaagagagcgattgggattacaatggttttcaggacttagaacattatgctgtattcaaaaacggcacccagatcctcgttgacattccagatgatgtcatgtaccatcacctacgtgaacatctgcgtaatgcagagatcgaaggttgtttccatcgtgaggaggaattctaatggcaaaaagtgaagttaaactggttgaattcaatatgaagcagaccaagaaagaagaggctgaagaaattctggcaggtcttattgatgaaggttttgtcctcatggggcagcacgaagccgaaggttggatgaattttacaatggtaaaatccgataattcactaaacgttgtccttaatactgatggcggccttacacctgctcaccagttccaggtggtcaatggtgcagcagagcgagttgttcattgaggtccgtatgaataaagtggtgtggagccttttcgatggctccggcatcatggggtgggagtatgctaaaaatggttataaggtgtactgcttcaactttgatgctggggatcatggtggttatgagttggtaagggttaagcatcctaatattcagtatgtcaattcttggatcgatgagggttttgatccagagaaagatgggattcctaagccagatattatctttgcatttccgccatgtaccgatatggcagttagcggtgctgctcattttgcctcaaaagcagccaaagaccctctttttcaggtcaaagccgtgaatacagctaaggttgcagcaatgttaggagataagtacgggtgtccatacatgatagagaaccctgtgagtgttctgtcctccaaatggaggagaccgaaccacatgttccatccgtatgaatatgggggttatctaccccatgatgatgttcatccgttcttccctgagtatattaatccgcgagactcataccctaaaaagacgtgtctttggacggtaatggttttaaaatgccacccgcaaagcccgttgcggtagcgaagggttactcagaacagcataaaaagctgggaggaaagtctgccaaaacaaaactgatacgttctttaacaccccgtggttttgctgctgcggttttttattccaaccagtaagtgaggctaagtgaaagagttattattagttggtggtcgagcagggccatcagatggagatacacgtatgctgctacaggctgacaaagtgagtggcatctaccccatagatcaagcaaacccgtcgcgagcattcacaagttacgggacccctgctggacaaagtacagtgcaggctaagtttggtcaatattcgtttgactgccgcaatggtggttttcaaatgtctggaacagtaaaacctgatcttgcatttgcaaaaggtgatccattcacgattgagttttggtcgtacaacacggcagtcgatagtgcaacctggtggatgtactttaacacaggaacttcttcctgtttaaaaacctatcagtcaactatttatttgcaggataactctgcttctgtacaggttggtccactgtcacgcataccgacgaaccagtggaaccacatcgcgattgtttacgatgggacaaatctccagttctatgtgaacggaaaccgcattgtatcgcaagcatctgctggcggctggagtacagcttcatcatttgcaagggtgatgggtggtgagggatcagcgaagtgtttcatggatcagtttcgaatttcgggtgttgcgaggtattcaggtacttcattcactgtacctacagcaccttttgatatggattaggaggtaagttgaaaaatgtggtgatcgcaaaagcttcaaccctacaaaagttggaggataatttgaatttcttttttgagaaggggtatcacatccaaggtggtatttccttccaggatggactttatattgctgttgttgttaggccgttttaaggagagatgatggggaatggtccggattggggcagcattgtggagtaccgagacggaaagctgtactggaaagtaaacaccttctcaggtagaaaccacaatcatccagcggcagttattggcaaggaagctggatcaatatctggaaagggatattgcactatacgctttcaagggtacaggtgttataggcatgttatcgtgtggctgcttcaccacggaccaatcccaaaaggattgcaggttgaccatatcaaatcgttaagggagacaggcggtgttgccgatgaccgaataactaatttacaactccttacaagaggtacaaatactcgtaaaggtggtggtaacatgcctaattcttccaacaagtcttctgcaagaagaggggtttcttgggatagaggttatccatcaaagccttggagggcaaggataaccgtagacggaaaagttctccttaaaaattttgagagttttaatgaagcctctcagcaaagagagttgtgggaaaaagagtattgctatggaggattatgagtaattttgatttttcggcttatcgacaaggtggacaggaaaacccgaaagcacaaagatttggcaataacggcaatcgtggaggaagagtgagttatcagcagcgcgaagaagagaccctggaatctgtagtcaatggcacccgtattctggcagttcctgaaatgagtctctcgcttgatgcagcgaagtattttaaaatccggtctgctgtttcagcaagcgacggtgtaaccattacagcaacctacttgccatattatgataagtacggtaagcttactggttataagaaacgtgactggacactaccaaaagagaagaagggacacttctctgtggtcggcactgtaaaggcagcatctcagttctttggtcagcatgaagctgctatgggcgctggtcgtaaacagatttttgttgttgagggtgaaggtgatgtgactgctgggtggcaggcgggttttgattttgtcaaagctttagctgcaagccccaatgccccgaaaggggtgaaggattgggcggcaagtgttctgaaaggtatcactgccattcagaacggtgaggaagttgcaggtattccgacactgccttttgtcggattaaactgtggcacagctaacgcagttgacaccttcgctaacaatgagaagtttatccgtggttacgaaaaagtagttcttggttttgataacgatgaagcaacagcgctggaaaaggaacgtaaaatcaagaaaggtaaggaagcgacagatgatgttgcagcattcttgctgtcagacaatatctttgtagctcgttaccctaatgaacgtaacgatccggctggtgttaaagatattcgagatatgtacgatgctgggaagggtcgtgaaatctggaacatgttttccaaggcagaagacaggtatgtccctgacaaactgatcagtctgagcaatatcaccattgagaaccttcgtaagaagaagaaagatggtgttccattaccgggtatgcctcgactttatgagttgacaaaaggcccacgtactggagagctttggacactgactggaccaagtggcgggggttgacaaactagccccttcatgcagtaatgtatgaagaaaaccttgtgaattcggtgaaaaccctaacgtgaagacgagggcaataccgagcgaagccgaagagtctctccttttataaggagggattatgtggaaaagtatagaaaattttgatggatacgaagtttctgacaaaggtgaagtaagagggaagagaggctcgattataaaacctgataccagtggcagatactaccgtgttagcctgtgccgagaagggatagttactcggtggatggttcaccgtcttgtagcttttgcatttttggaacccatagagggtaaaccttatgtgaatcacaaaaacggtgataaaacggataactcagttgacaatcttgaatgggtaacccaacgggaaaatcaagaccatgctgttttaacaagcttgtgtcctcgtggggaggaaatatggacatctaaagtcacagagagtgaagttcttcagatagcagaaactttgcaacttgaacttccagtatcagaagtggcgagaagattttccgttccttttcggattgtaaaaagaattaaatacagagaaacttgggaatggttaacctctgaatacgaattcttttcaggaagaccaaaactaaccctgctttcgggagagcggcaacagatatacgacctgttgaagtatggcttccccagcagagaggttgccaagatgtttggtgtttctaaaacgactgtattaaacatcaagagagacttttcggaacgtgtaacgactagccgtgatgagtgtaacggtgtacatccaagtgggtggaagcgcaaggcatcctgaaaggatgatgatatagtctgctctgcatggaaacatgcagcagaccccgatacgagataggggtcgggcaaggaataacgaaccttgctgaacataaggaaaagtacaatttctcgcaagattgagtacgccatcgtggattatcttcgcaatatggatattcctcgtcttgacgggtggactgagaacgagaaagtggcaatcattcgcctggaagaggatgaagaagagtctgtaaacagcctgtatgctgaagagttgaaagttgacccgaaagcatttgttgcagatcctgagcagttcctgactgaggaagagcaccttgccattcaccaacggtggattgctgaggacaagattaagatctttgaccacttcggttctatcccgactgatcagttgattcagaagctgaaacagatggtgttccttgatggttgtaagtggattatccttgaccacctgtcgatggtgatctccggtcttaagtcagacaatgaacgccgagatttggataatatcatgaccgagcttgcggcattctgtaagcagtatgatgtgttcattctcagtattagccacatgaagcgtaaggagcttcagttaccgaaggataaagacggtaatatgttgcctttctggtatcctgtacgtaaagaagacctgcgtggttctgctgcactggaacagctttcctggattgtattgggggttgaaccagaagaactaccagaccgctctcgtggacgtgtgcgtgtggttgtgatgaagaaccgcccacacaaaaaacttggtgtcgcagacactatgatcatggatgaaaacggtcaattcaccgatgcatctggttgggtatgggaagatgggatgttcaagctggacggggaagtcatgcttcgccctgaaggtatggttcagaccctacaactggagactccggtgggtaaggtcaatgtaccagcacctgtcgtggagaatccggtgcaactcccatcgccagcagacatggatgaggatacgccgttttgatgatatattaaccaactgagaggtgggtgtcgatacagaccaacccaccttgcataggaggagcatgaaaggtttgtttataacggacaacgaagctgatggtctgttagaggaagtaactaagtaccactgtacccttctgaaggaatacggtgttaacaactggaatctgtttttagatcctgcacacccagagtatgagagcgccgtaacatatgctcgcagcaagacagaagccaatctcacgatccgctcatatgacgagcttgaggcgttcctgaaaacttgccgtggtattgcgtgtcacaacctttttggttatgatctacgcctctggaagaaactgtcaggcattgagtacgacatgttcaaagaccctaagtgtctggggacgattggggatacccaagtcaacctgtacgatactctgtctatgagccgtgtactttatcctgaccgaccactaccaaatggctgtcctgattcagttttgaacccggtaaccgggaaacgtgaccgtgttggtccacatggccttatggcttggggctatcgtgtggcgaacaagaaagttcagattgatgactggcgtaaccagccgctctgggagtacgttaaccgtgtgtgggaagacgttctgatcaacgaactgacgtggaaagcattgattgatgaatccactggtgctcgttggcccgatgacaagcagttcatgtacacggataaacccgaaggtattcgccagattaactggaaaaacgctcttcgtcgccgtatgctgacggattacctgatgattgagcaagagattcagggtgttccgttcaacaagcatgaggcggaaaaacttcgagatcgcattgatgttatgatgaaagagatcgaagaagaggttgaaccgttacttcctatgaaggagatgacaaaatctcaacaacctaagttcccagctaacccgtttgatggtgctggtaatatctcccaccacggatggaactggttacagtacaagcttgggtatccggttaaccgcgaggcgctggagtttaagggtccaccaaaaaccgctttcaaaagtaatggtgaggtcagtgcggcaggggaaagatactgcatccagaacggtgttgaagaccctatgcacttcggggattttatccgggaacaaaggaataaagagaataccctggtgcctctgccacctgacctgatggagaaggccaaagaggatttgcggaatggtaagatgcctgacctgatggtcccgatgaagatctcgaaccaggacgacatcaagaagtacctgatccgcgatgctgactggaagcctaccctgtggcgtgtaaaagatgtgaccaaagatcagttcaagaaggccagaactgacccagagattgacgaattagtcagaaagtacattgaggagcttggtgaatcagagtataagtctttgattattgagcacttaaataacacagacgacaaattcaacatctcagagcgcaagtttgatcatcgtcatgcgtctgacaaggcgtatgcggaaatattcaagaagttccggcgcaaagctcgtcagttaccaacttcaccacagttgaaggataacttcggcaagctatgtccgaacctcgaacgtattgatgttcacttggcaaaacagatcgttaagtggttgtcactgcgtaaccgtcgctcagtcctcgacccgattgatgaggataagaatgacacaggtttgctcaaccaccctcgcctggcgattgatgggaagcttcctgcccgtttttctggaatcaccaacaccgggcgttgcaagcacaccatttgtgcaaacatgcctaagccagatccgaaggtgttgctcggaaaagaaatgcgtggattgtggggtgttactgacgggtattatcaggtcggtatcgacggctccaacctagagggcatgatcgccgcatggggtgcataccagttcgatggcggtgaatacttgcggatcatggagagcggagacgctcacgcacgaaacgcagaagcgtacaccaaagcttcaggaaccctcgttacacgtaacggcggtaaaggtgtaacctacggtatcatgtacggtgctcaggcggcgaagattgcagcgatgttgaacatctcccttgacaaagctcaggcggtaattgatgctttctgggatagcaacttcggtttgaaaggtcgtaaagaatggctggagaacttctgggaagcaacagggaagcgttatattcctggattggatggtcgtaagatttggacccgttctaagcactcgttactgaatgcttaccagcagaacggtggtgcatcactgtttgaccttgttggcatcctgctacactgggaactggtgaagcgtgggtggtatgatgacgatgtacgtcgcctgatctactaccataagtaacattgtggctttgtgaggtaactcacatcgaataactcttttaattgtcgggaaggctaaggttgacagttttggtagactgttatactatgctaatccgcagcgaagcttgtcaggaattttagagacaagaacgttcagagactaattcacttaaaacaatccagctatatgcgaggagatacatgaaaactaccaaaaaggatcgagacatgctgattgccattacacttggcgatggatggttatccaagcatggtcatctcgaagtgtggcactctatccaccagaaagagtacacattgatgaaatatgagaagattaagaaattttgtccaagtggtattttataccggaaaaacagcttgggtaaggaacaggtgggttttagaactaaaagattacctttcctaaaattacttcgtcgtattttgtatcctgaaggtaaaaaagttttcagtggtagattactaaagagacttggaccagagcacttggcgatattgtggatggacgatggaagtttaacgaccctgaagaataagaagggtgttaagtcatcctccagatatacgttaagtctttgtactagcagagagcaatgtttgctagttgctgactggataaaatctcttactggcgtatgcccttggataagaagtgtcaggggtggtaaatatttctctctttgttttacaacaggggaggggaggatttttagccaagtaatacgaccattcatgtgtaaaagcatgatgtataaggtgagccaagattaattcttgggtaagcgaccaagtggcgttgaaaaagagagcatcccttgtggatggttagatagtccgatcctacgtgaaaacgtatggcaacacgtaatggtgtgggcgagattaacgacctcgctaaacttttggatgaataccagctccaggttcctaagaaatacttgaagaagtgggagtttgataccctggaagatgcaaaagctttcgtaaaagaatgggaagcaaaaggccgcgtatttgacgggcatgagtggagaaaggctgtaaaagacgagaatggtgaaaatgtcaaggatgccgaaggtaatacggtgtatgagggcgtctttggtgaagatgggaagatacacatccagtattgccctgttggtgagatggtggtgaaatgtgttgagaaagctgctcgtatgatgggttctccggtgcatatcacaggtgcttacttaacgggtaaaaactgggctgagtgtcactaaatttaaaggggcagacgcccctgttcttggagactataaatgtttgagatgatgcttgctacaagtgaaacaaagaaatcgattcctgttggtaatgtggaatttaccaacatatcttcctccccacaatcatggactgtccctgccaatgtcgaggaggtcagtgtactttgtgttggtcaaggaggggcagcacaaactaatccacttccaagacgtggaggtgcgggtggagacttggtgtggagaaacaacatcccagtttttcctggagagattttacaagtgtttacacaaaataatgcagatgggacgacgcttgtaggtttgtttcgtggttctgtaccactagtggctgctggtttcgggtcaggacctgaaccgtacacggggcaatacccagatatgggtgatgcagtgataaataaaggcggcgcgggtgggaataatacctcagccaatgatataaaacgttgcagtggcgcaggtggtgccgcagggtatattgggaaaggtggtgatggcggtaatgcatacccagcatcaacaatgtactctcaaggccaggatggtcagggaggcggtggcggtggctcatgtggttattacttctctggttccacatctggggagaactccggtggcggtggcggtgtcggaatctatggcgttggggtcaatggtcatggaggtagaggtggatattcaccaacaatagcaagaggcgggtctggtggggcagaccctacaggtcgccagggtggtaaatttgggggtggggctggacacggatcttcaagctcacctggttcttcagcggtgcggataatctggggaaatacagaaaagagagaattcccaaacaatgcccgaaaggtataaataaataagaggaggatgtatgattaaagaaggtcagttggttagattgaaatcaggtggccctgacatggttgttgagcgtatctttgaaagaccgctgacctccaacggggtaatcagtatcgttaaatatgctgcctgctcatggatgaatgaaagcaatgtgaaacaggtggaagactttgcttttcctgcacttgaaattatcggagagtgatatgaaagtaaaaggcacacaaaccacggtgcaaaccgtggatgtggaactaagcgatgctgccatcaagtcggttgtttatggtcagacgattgattatcttgcagatgctgtggaggaaaaacttttgtaccgcttcctccacagcttgccaccggagtttgacggtaaaaggacgatcagggaaagttaccgatctgggaataaaggtaaactagcgctggtgcatgtggatgcagactggaattaccacaacaatgttggagaggacaaggaagttcgtttattgactgaagaggaatgggaacgttacaaagagctttgtaatatctccaaggtaattaaagacttgcaaaaataacgtaaaagccccttgacttcatggttgaggggctttatttttaggggagttaaataacctggagggtggtgtatgttagaggcaatcaattatttctttttagtgctggcggcagtgacatgtgtgtggtgtggctttggcgctgtcttttcaaaaaatgaaacacaccgcgcggtgtacgtggtttgtgcagtaatcaatgcttcctttacggtgcatatctggagtatcgccttatgaaaggtcacatgccttggattaaacccttggtgattgtcggaataattgttgttgcggtgtttattgttgttgacatcgcagataccgtcacccataattgtaagcctaacggtgaacaacgcctcgcaaacagtgctgatggagttgtcgttgagaacaaactgatctgcgacggtggtcgcgtgaagtggtctcgttactaaccctgaataaataatctcaagaggagattcaaatgaaaaaattaacgattgctctgctggctatggcttttgttgcaaccgcccatgcggaagaagatgatgatttccagaccgaacctatgtgcaaggttgaggtgtgcaacaagatcgagcgtttctctctgagcatttggtctcatatgaaggatagtatgggagagacctgtatcgacacggtgatccctaaaaaggatgctcaggtggggaatgttctgagcgaagagtctcgctggtatcaggggtcatctatcaacccaaccaaaaaatctgtgacccgtgtgtcacaagtctacaaatgtcagaaggggtgatcatgaaaaagattatccttgccaccctgctcgcgctttcttgctctgtacaagcaacagagttctataccgataccttggcaaaaaggatcacagatgcaggcaatgctgatatgctggatgcttacaaacagggtctggaaagagcaaaggctaagaaagatgcggcagaaattgaagtaaaaattgcagaattgcaagtggcagtttccaaaatggaaaagcagatgattatcctcacaaacgctgttgaagaaatggagaaaagcaaatgactatgactcgtggccttatcttcggaaaatttgcaccgctgaccaacgggcatgtcgcatttattcgccaggcggcttcgcaggtgagttgcctgtatctgttcctgtcgtatgaccagaaatttgttgacgcacaaccagagtggattcgtccaaagttgggtcttgctgatcgctatcgtgacttgctggatgttattgccgatgagggtctggataacgtgaaggttgactacgttgatgagtcgaatatacccggataccctgaaggaggtgctgcttatgcaaaactgatccgtgaaaagcaacctttcgttaaatacgactttgctttctcttctgagccggagtacgagtcttacttcagtgagttcttccctgaagcgaagcatgttgttatcgacgcagaacgtaaagctgttcctatctctgctacgatgattcgtaacgacccgtacaacaatttctataacctggcatggcctgcacgtaaacgcttcatgaaaaaggtcgccattgttggtgttgagagcactggtaaaacgaccctgacacaacacttggcacacacattcggtgcagcttggattcctgaaattggaagactgatctgtgagcgtgagtatcactccagtgagcttgcgatgagtcgtgaggattacctgcgtgttgcaatggagcatcgcctgaaggagatggaggtggctggttggggtgaccgtggggtaatgttctccgacaccacaaatctgatcacacacttctctggtgtttgtgcagataagatcgactactccgacctgttgttccggacactgagccgtgaagagagctacaacttctacgatctgttcctgttcctcacaccagaggttccgtgggttgctgatcctcttcgtttgcaggatacaccagaaaagcgtaaagaaacgcattctttgcttgacacaatgatcagggcatcttatgatacaagcaaggtggtggtcatctccggcaatgattacgaagagcgtactcaaaaagccgaagaagctgtccgtaaattgctgaatatcaaaggagaataagatgaacgtaactaattcaagcatgaagcaggcttttggtgttctgaaggttattttggaaaaggcccctgagttggctgaaggtcttcaggcttacgctaactgtcgtgagcaaggcttctctataaccaagtggaatcacaagtgtgataatgacctttcgaggcaagtttctttctccgagtgtcgtaacagtgatcagatcaatgtgtactggggccgaccaggaaacttcaactaccagacgaatgtgcctgacgacgacacgtatttttctcgtcgcaaatactttggttatgaggagtatgaagaagcggcagactggatcatcgcgtacctgaaaggtgacttagatggatcaaaataagcaggttttggtctggaaaacccaagaaggtaatcttgtccggatcacccatatgtctgacgagcatttacgtaatgcaatcatctggctactgacagactcttgtcttgatgacaaaacagaaggtgtgccgataactacgtgggtagaagcaatggctgtggagttaaacagccggatggttggtaatggctaaggttcttaacttttaccatattggtaaggttatccctgaaggtgcggtctacatgggccgcaccatgaagaaatttaacctggtgggtcataagctagccaacccattccctcttgagaaaggtggtgggaatcgtgatgaggtcatagaaaagtaccgtgggtggttgtgggagaagatccagaaaggtgaaattactttgcaagatcttcttgacttggacgggaaagaccttgtatgcttttgttcaccgaagagatgtcactgtgatgtaatcatggcggcaatagaatgggccaaggggagggttacaaaatgagtttgaaaaaagatcacacttatatcgagatatataagaacatcgctggaggtcactcccttgtgatctctgatgatgccggaggttatcgtctggcaggtacaaagataactggtcaaccgatagcgcgttttgaagtttctgttgaagactgatgatcgcagtaaataatcaccaaggagaataacatggtttatggtaggggtataaacgactcagattctccctgtcagattttcaagtgggtagatggtagacaggttttggaatggagatgcccttactatgaactttggatagggatcttgtacagatgttattcaaagcagttccacaaaagacaacctacctatgccggatgccaagtggcggatgactggttaaggttttctgtcttcaaagagtgggtttctcaacaacccctgcacgaacagtggttgaataaggaaggtgatcttcaatttgacaaagacattcttttggaggggaacagaaattacactcctgaagcatgtgcgttcgttccaagatacataaataccgcattagcctatagtaagaacagcggcctacctatgggtgtaaccaaaaaagaaaacaggaaggtctatgaggcggggtgcagggtggacgggaaaagaaaatacttgggcgtgcgagcaaccccccttgctgctcatgcattatggcaaaagcaaaaggctgaaaatcttcaatctgtgatcgaggtatactcctcatctgaattttataatgagcttattgcgaaagccctgcaaaaaagagttgacagaatactaaatgacctccaaaatggagaggaaacaacttacttatgaggagaaaagattacatgatgaatctatacgtaaaaacaacctggaccgacttttatggttggtcgaaacttgaatatctgtggctgttcatctgttcagcctccatcgctctcgtgtcgatcatcatgggcggtggggttattgaatttatctcgtctgtgacaggtattatcggagcgatccttgttgcaaaaggtaaactttccagttattattggggctttgtggcgacagtgttgtacgcatacatctccttcacgtacaaactgtacggtgagacgattatgtacactctgctatttactccgatgcaggtgataggtgggattatctgggcgaaaaagctgactgtctctgaagacggtgaacgtgcggatgttatcaaaaagtacctcaccacaaagcagcggtggttggttgggattggaacgttggttgtgatcgccttgtatgcagaatttgtaagccttctgaaaggaagtatgcctggactggattccgcaacagcgatcctctctgttctggcaacctatctgatgatggtacgttatgcagaacagtggtacgtgtggatcattgtgaacgtagtcgcagtcactttgtggattcagacagcgctccaccatgaaactcaggggtgggcggtacttgcaatgtggatcactttcctgttaaactctatttatggtgcctacaaatggcgtaaaaacgaaggagctatgtaatgattggattttgggaatggttgacgatgcacaataactgggtgccgggtactgccctttatattacgatgtttgtttgggccactgtcttatctttcagggaaacatggaagtataaagttatggcatatttaatgctggttgtggtagttggtacgctatttaatgccttgtcaacttatagtgatggttatcgcatgtataaaaatcactggaccacttgtgcaaaacctgaagctgtggcatcattctatgtgttcgatgcacagaaagaacggtgctttaaaccagtagtggggtttgcaccagttgatgatatgcaggtgaagaccttaacaccaaaacaaatggagacaggcgaatggttatgaaatctgagcgaacaggtcaaaaatttgtagaaatgtacgaagccagtttaggtgagaatccaaatctggaagagcagttggtgctggaatacttcaagaagaatgttgaatatcttcctgtagattatgataatccaaccagtttccataaagccttccgtcaggtcgatgtctgcaagaagggttatcaagatatggtgatctggagcctgatgtctggtggtgaattgaacacaatctggtctgtactggaggagttttatgcgtaaattctttaagtggctactgagcctgtttagttcaaactctgtagtgaccattggcagtggtaacaccaccacagtgacccagacctcaactgtgcatgttctgaagggacgtgacccagagggggattataagtacaagcttaaacccctgactgaaaatgagatcagggatattgctaaaaaggcagtggcagatgtagcagctaaaaagctggtaacagagggccgagaagagcggctgaaagagataatggaagagttggatcgccagcgtaggaaccgtcgcccaccaccgcctcctgcacccccacgtcgccgtgtggttgtggatgatgattctctcgcacgacagagacgcagtgaaacgagttacagtcgtaacgatgacgatagcattgtaaccagcgcttttgttgcctctgctgtttatcactcgtcaagtagtgacgatggtggaagttatagcagtggcagttgtgactccggcagttcttcaggaggatgtgattgaaaataacaaaaacgtttgtttgtccaaacggtcattccactacctcagtcgtagagcactttgtatccacgattgactgtgccaaatgtggtgtaaaagccacatatgtaatggcactggaggatggtaatatggtcgcaggaacaacatcttgtagcttcccatcgtggatggatgatccttttattaaacctatcaatgtaaacaaggagtttatgtaatgaaatttttatctgcactggcgcttttattcatcgccttgaaactgtgcggggttattgcatggtcatggtggtgggtcttggcaccactctacttcccgttcgcgatttttgtggggatcataattttgtttttcgccagtgtctttggtgttgcaggggcggctgctcttctggagaaaatcaaattaagtaagaaaagatctcgataactattgacatacagagttgaaaggggtaatataccccttcactcacaaacggaggattgatgactgaggcagtaacccctatcgaaacccaatcagaaaaagaaaaactgttcttcctcgaactcgacgaaggtcagtttggaactgttgtttttctttccagtgccggagcacagatgaatcagttcatcggctcagagcgtatgcgtgatgagatgctgaaggttatccaaagcggcaacatcactactgtggaagaagctcttgcatgggtgcgtggacaccgcaataaccttctgcaattaaacggtgcatcgtcttttgccctgaatctactgagtcaggttgaagatctggtgatcgatagacttttgggtgttaacagtgatacccaacaagaagaaactaagtaataggagagagaatgagcgtaattaacgaatacaaagatccgatgtccggcaaggtaaaccacttcgcaaagggcagcatcaaattcatcagcatcaaacctgttaagaatgcagatcctgatggtgtgaaacgtacccatatcccagcgcgaaatggtcagcctgcaaaggttatcgaatcaacacataccatcagcttcttgatgcaagaggtggacgacaataacaacgttattgatcctcaaagccagggtgagtggatcggcatgggggagaagaagctacatgcaagccacaccgacaaagtgcaggttaagctggactctggttacaaagacattctgcctggtatggttgcatctttcccgctgaaagtgagcacgaacggcgataagacctatgtcaacggctctctgagtggcaagactttcaacattctggacgaaagcaaagcaggtcaacctgcaccacgtcagcagccgcagcaaagtgctcaaggtcaacagtctggtggtggggtgaaagtttacggcgagatcaccgctattgcagggaatctggcgactgtaaatgatgagaagaacggccctggtaatgttgttctgtctgatgagcaactggcacaggtacaggttggtggtcgcctgacagcttttgtaaatcttgctgatggcacaatcctgaacggctttaaagcttacggcccagtaggtcaaggaactggctcaggtggtaagaagtctggtgggaattatgaccctattggtgtagcttgtggtcacggtatcaacggccttaaggaattgatgggtgcaggttacaaagtgaaggatgaactggaaacagtaaaagccattcaccgtgcaactgtagacatgaaggctttcgttgcggagcgtactggtaaggatgttgaatcaaacgctgttggagcaagtgcaggtaatgcaatccttgttgcatgtagccgattcaatgccaaatcggaagtaactgaggcaacgatcctggaaagcgccaagaacgtgtatgtaacgctctctgagccgttttatgagttcttgactaacgatggtaagcctgcggatcaaacccaaccacagacttctcaggagcctctgagcggcactgttgatgtaccacctatggatgcttatgagcctccgatggactttgacgacgatataccctttgccccaatcggtctgcaatatggtagaaacttcatccattgcatttaataaaaagaaaaggagcctttcggctcctttttgttttattgcggttgagaaggtacaactggttcgccggggtccacaggatctggtggggctgtgaagtctgaaacactgacatacgaatcatcaaatgcctcaacctgaccctccctgtaaataagacgaacaccacaacgggcatcaccaactgcaatacaggaaaggaatccaccctcatcaatcatcaccacatccggatttgtagttgttaattctccgtctatgaagttagtatcaacattggctggagaaatttccattccgacaacgttcggacctggtgtatagtcaggactgtttttatccatgaacacgaacacatcaccaacttccttttgtgggatggaatcggtagtcacagagaagatggaaacataaccgccagaagtatctgtgagtgttttagcatccgcgccagaccctgttttagcagtcattgtgatgtcaaaaccaccctcttcaaggaaggtcatgataccatttgagtctacagttgcgatattaggagcactcgatgtgaacgaaatatcataaatctcagcatctgctggctcaacagtccacgtaagttgacttctcgaccctttgatagcgtatgggatagaccctgtggtgatagcatccgcagttgtccccccaaaggatgcttctgggatgtttgtgaactcaccagtgctatcggttgacccaaagaaaccataaaggttaccagcgtagtaaaggttcccgtcatacaccatccaatggctgatagagttcccctggttaaggacatctgtcttcatgtctacaatgtatgtcagcttcgaaagatcccaatcccttcctgtaggaactggaacaagggtcggttctaacaccattgttgatggtgtgccaaggccaagttgagcacttaggtcaccaagaccgtaaagcttgttatcagcaatcaggaaatgagactgaccaccgtcgataaccctgaatgtctcgaaaggaccaataccctctttcttagagtattgggctgtcccgatacccctcgtatataaataatgctctgtatcatcaacacctgtagaggcgatagccattgagtttgtttcgttcgctaaccactctttaacatagacggtttcagtcacagaggcaaaactaacatcgataaagttttgtgtttgtgttgttgaagtaccatctatctgatgggtggccccacaaacacggggaagtccaatattgttcaggtatgtcacgcaagcatttaagctgtaagctctcacagaggatgcactaatacttcttgggatcgatattacggtagtattaccagagccaaggcatccatttgtgtttgacccgcttccataaagtcttccatctaccatctgccagagtgtgttaccgagagcacaagaaacactttgtaaatttgcgagggatactgtgcctgtgattgatgaagggaagcttgtccaagaagaatagatagacccactaccagtgaattgactggtgtccccacaatactgccagccaccattgttgtatttgacaacaaaggctctaccaccaccaaaaacatcagctacaccattagccgccaagtgccaatgatccttaaacgggcttatgttcccgtttgcgcattcagaccacgcattatccccttgggtatagagtctcccatcaatcaggaggatcgccattgaccttttggtagcaccaccaaccagaccacgggtaaaggccaccttcttaacactacctggtggtagtggttctgttcctcctccagataatgtcaagaagagacatggaataggatacattaaaacctcctaaaagaaaggctgtccgaagacagccttgaatcattacggacgacgaacaattacagtgtcgataacaccgccttcaacaccattataggttaattgaagaatagtcaccgaaccagccgtctcgttaattgtttcgctgtttaaaaccaagtagttaggatctaaagtcacagtgtgaccgccagtaccatcttgagtcaggtaaatcacagcagaaaaagcatctgtcggttcaggccaagcaccaattgttaaatccgcatccactgttacgttgtagatgttggaatctccacttggggaccatgccgctgtagagctatcaatatcctcagcaataagtgtcaggaattcaacacttgccttggttaagattgccgaatcctgtaccgtaaggctattggcagttactgcaccagtagaggaaagagatcctacgttgatgttctgacctgtcaagtcaacagaaagacctgtaaccgtaccctgaataacaaggttgttaactgtcgttgttcctgttgcgttgttaaggttgacatcaccgtttacggtcaggttatcctggactgtaacatcggcaagtacgctaagatcctcaataaactcagacgttcctgtaacagagagttttccgccaattgtaccatctgctgttccggttgtaaatccaccattgagactggttaacccacccactgtgaatggaccagtgatgtttccgttacccgcagagaaatcttcgagtgttgtattaccgtttacggtcagatcacttgtaatatcaaggccaccgattgttgcgtttccaaggttggtaacaccactgacctgtaagtcaccacctacagttacaccgtctgcggttgtaacagagtttggtgaaatatcaagtccgttgacactgaaggtgatacctgttacgttacctgtaatattcaggttttctacctcagttgtacctgagacctttaatctcggtgctgtaggatctttacttgcgttaccacggatatacacataatcgaagacgttattacccacacctgtcagagacatggttgtatcatcttcagccactgttccgttgacaataatgtccgtctggatgctgtgggtttggatcgcatatgggtcaaggcgcgtcttaaagaatgtcggattatctgcgtctgtaaatacgaaggtaagacttgacaactcttttgtcaggatcaggttctggaaacgacctgttgagttatctgcgtttacagggccattaaggtcgattgtcccaccaaccaccaaactattgagtgttgtagcacctgttacagacaggtttgcaaaggtaacactaccacctgagatgcttgacaaggcgcttgcaatagcggttgtaacaaaggcagttgtggcaattgttgtactgttgctgttagccgcaggggttggagcctgtgggtttcctgtcaggatcgggctgttgattggtgcatagatagatgccatcgccgctgcgtcgttgtacaatctccagttaacactgttagctgggttttgtggtaaaacgacaggggcgcttgctgttgcggttggtgcataccaccattgaaccccatttgtgccattaaaagcataaagctggttgaatactgtggtctgagtacccgcgatccacggcataggcggtgttttaaagaacaggttgtcaagaagagctttacgaaccgttggaatggtgctaccatcttcagtaacaacagtttcggatgccgttccgttgacaaccttgtggaggcgttcagagtcttcaacaacctgatcgacagcctgttcaaattgagtcatgtctgccacaagagtctccttattggtctgactttggttctgtacgttgggcttctgttactccccagcgtagagatattagcttactgattagttgaggtgcagcaactgtgggtgcataaatccacatgtaccactcggtcaacgttccattgaatccccagtaaaggaaaactgcggtcattgaagccaagccgatattgctccaaaactttgtgtgagaaaccctctcagggtctactggtgatctcacaagatctttaataaatttcaatagtgattttaacatatttcctcaagattctcaatgaactaacatgggtaggaaccttgcaagaaccacgaggcttaccacagtagcagtttttagccactctttaaccgtattgtctttaaatgatgcacagaggatcaatacttccataacggtctgatatgaagatttgatgacaaaactcaatgcaagtggcaaaagatatggaaattgcatgactattatctggcagaagagtacaggcactgatacggaaagcatcagcttcttcttccatcccgacaatacacacgctgtggcgaacaggagggttatgtcgagcaaccaacataatgacatatatagagacaggtcaaagaactggatatgaactgaaaaccaccagtacagaatgttctccagaaggatatggatcataccaaaaatagacatgatccttatacccttgtctgcattaagcagcagcactgcaaagcataagaaatacagtgctgaacttatcatcgacgttgattctccatgagtagcttgaactgattgctgaggtcagcacgaagatcgcccacgtcttctttaatgtccttacgcaagtctgaaacgtcatcacgaaccgttttgagtttcttatccagaatctcgtcaagtttttccttagtgaccatctctgccttaatccttatgatgtctctatcaagttcatcaaggcgctcttgcgtttttttgtaatctgagtatgtgattctcaggacaccaattaaaacaaacgtgataacgccccaaacagctttgaggatagcaaataagtcaatagacattatagaatccttttgctcttggctggtctttcaggccacttgatattaggagcatcctccgggtctattgctaaaagatcaatacggtatgtctttagcttttcgagatacgctttctgggaatccaaagtaggtcctctggaaatcaaatcttcaagggctaaaatctggtttgtagcccaagacatttcactgtccagaagaacttcggcctgtgcaatagcctctttattgtaagctttaaactccccagagatgaattgcacagcccctaaacgggattcaataccatcaggaacttcatcaacaacagcaaccttcatttggtctgggaagtatgctgatggatcagaagacacacacaacacgacatcaccggaagacagaagaaggaacttggtcccctctttcaattttgtcaactctttcactatgtcgtaccaatcttccccgtctttatctttcaggaaaactgcacctgactccaggaatgcggcgttctcgtccgtctttgttggggtgtataatgaaaattcaccatatacctttgtcataaatcctccttagtccaggttggaaacagttacccattgtccgttaatgagatactgtagtggtgcagtgtagtaagttgcgcccctcaattctttcttgttaccgaaagcccacccggtcatgacgtgacctgcataaaatctggattcacttacacctgtggcaaacctattacctaaacggatctgctgaacaaatccagacaggtttagtgtgacgttaccgttaccatctgccgttgcaccattgattgctctcacaacgtttcgtccaccaactgtagcggagttgttgttgacaacaagggagttaacgttacactgtccgtttacactggcatatggggttgttaaagagcttgttgcgacaacgttgaacccttgaacgtttcctgttgccgttaaggtccctgtcctgattgttgtggactgaatagttggagcattcagcgtaccgcttacggtagtgtttgtgaagtttgcagtggttgcagtgacgcttgcaccgcttatacttccgcttgcgataatgttaccagttaccctacacagtgcagcagtgccactgatcgcattcaactccatcattgtgaagattgagccaccagaagggacgaagcggaaacgcatactatcgatgctcgacgtacctggggcattaccgatattatcaccaactacaaaatcaaagaatgtggtgtctgctgctgggttggtggtcgtgatgtatgcgtaatctgattcggatggttggaggttcaggcgtggaacagataatgcaccagtcatggtgtcgcctgaaatgttcacatatctggtatcagactctgttttactccaaacatcgaggtttgttcttgctgcggccttgtctgcaaggtctgcaaggttctgattcacacgtaagaaacgactgtcgagaccagggatctgctcaccagtgatatacttggcccatgcagtcagcatatttaaaacgtagttaaattcttcgactgttggcttttcaccaaggtcccaacctttgttccacaggtcatcgataggacgtgctttgtttaattcatgggtgttaggaagaacaatatctccataagcccaaatctcaataggtactgttggcgctgccattgtaatctcccttaaatcaaggtattctcttcatcagacacatacgtcaggtgagcaagaccaccctctcctgttcggcttcctgagtggatagaaccgaatccgagtgcatgtttatcgcctgcgaatccaaaagccgtaccagttgactctgttagtctcaggtgtgttggcataggcaacatgtcttgaatctcctggagagcagtctccaattcgaaacatgttttggaaatgttaatatcgaaacggtagttatcacccttgtatgtggtaaagttaccttccccgaacaactggttaagggtatcgataacttcaggtcttgtcccgtgcttcgcagcacttgccaaaaggatgataatgatggcacgatagttcatatcgctcaagccatcacgctcaatcccgacctgcttccctatctcatcaaggttgacacctgtcgcatttttcagtaatctgccctcagacaagttgacccacatttcatcaagctttttgaggcgttccagataaaccgtcataaatttgacaaggttttctttctctttcagaaaatcgccagggaggtattgaatacctccctcaacgaaatctggcagagtatggatgtggttgacatcctttaaatagtctgccatacttacctcattagatgatttgctggaatgtaatgtcgtctgtatctaaagcaaagacttctgtcatacctgcaacaacatcgctgttagtataagcactgtcaggttggtcagtgttcttaacatccaccaacaattgcgtgaagcgccctggtgaaatagaggaaccaactgcggataccaactggatgttgtaaagtgtatctgcaatgttgagaggatcaacaacggctttcaatgcatctttgatagtgttttgctctgtcacggacaggagctttcctttataacgaacacggactgcaagctcacgagcctgtgctttgctgtgatagatacgttccgtctgatcatcctctgtggtaacatcataaaaaacattaccataggttgcgttggacaatgcgattgtgttataaagtgcttcactgatttcttctgtggaaccaccataaactacagtctcaaacttatatgccggaacaccaaactggtctgtttcccctgtgttgtttgagaatacacgaaccttgctgacgccctcgacgtttaaaacggcagaaataacggcaggtctagtggcagcagcacctgctgcggtgctttgtgaagcacgaaccttgtaatcagtgtctgtctcaacatcggaaccgtcattaaaggcggtcatgttggtcatgctgataaaaccgcttggtgtcggtgtgatattcgttacagtatttgcttcacgagaaatagcccctgcttcagcagcaattacttcaatggtaattgttctctggcccactacgggtgatgaacggaaatcaacacgactgttaagtccgatcattttcttgttagcatcatacccgatatacatcgctccacccgcagagtcaatgaagatcctgtcttcgtttaactgtgtggagttgtcaacaatgaaatccttaatcgatgacatgaacgcatttaactgagggctgttaggcaccttattacttagcgtcaagttcattgattttgttgaaccatcgttctgattaatcatctggaacgtatagttaccaagaacccaatcttggttaaggatttgttgcgccaggatattccctgcgacaggagtgtcctgcgtgagtacgaagttaccactgtcaatgctatatgttgaagaactgtaaatcatgttgtacgggacggtgttgttaacaaccatctggatagtacctgatcctctggttttaccacgacgataaataccacgacgaccaagcagttcatcaagataaataccttctgcccctgcaagtgtctgtgcagaatacacagccgcagccagaaggatcaactgatattctctttcattcaaaattgtggtaagtttgtcaacaacagtgttagcctgagtgttgaagttttcaccaaaagttcggatcagcgactgcttggtatctgcgattaaatcatcgagggatgggatcgcaaagccgtagtcatttaatccatattgagcagccacgaacgcctcctcttgctagatttttgctctaagatgttgctattttatcatattgtgatttaattataaaggcttataataagaaaaggggccgaagccccttgttatttaagtcctttcgctgtatactacgggatttgtcgaaacaagagccgtgttatcaggtgtggctgtctggattggatctgcaatgtccagatagaacggtgtgatccaagcacctttttgatatggcgctcttataaccgttgtctggagatccgcaccaccggggcctgcgcctgggatggtgagttgcaacccagcagatttaaatgcacgagtagcccaaggttgtcggatacttgaatctgctgcacactcaatcgtttttgagccaaccacagttgccttgatgaaatcattaggttcaatgtaagaaccccctgtctcaacaacaaacataccaccagtcttcttcagaatgatgtcccctttaacgaattcctttccttgaggaaaatcatcattatcagagatatagatgttaccagcattaagcagtatgacacctctgtttccgtttgtctttgagtgctgaaccacatcgaagttacaaccgtatgttgttaagtggtcaaagcctacctgaccgaacttaccgttagcgacaccattatcatcaaggctattgatattaatgatctcagcagaacaccaagcccaacgcttcatcgccccgcctgcctcaccctgtccagcctcatagtcgccaataccatcaaactgtttacagcggatgtcagcaagacgaagttttgagacaagaccgcgatatttgaaagtgtggcactcaatgtcctcaaccttcacatcgttggtccagtcatccatagcactaactggaatatctaccagtcccgtatgagtacgtacatttcgcagtgtaaagtcacggcacggagcagcaaaggttccttggttaacaccccacccaaaataaatgaatcgggtagcaccgttgaccatttcgccacgaacaccatcaatgatatagtctttgcaaccataacatacgacaccaccggatgccagcagtgttccgttagaaacggatgcatcaggataaacctcaacgttctcgaccttaaagtcacggcaaagctcgaagtggatacattgacgaactcgacgcatcttaacgttacgaatgatgatcccactaacatattggtcatcagaggcgttagcaccatacggtccctgccccgcaacaccgataccaataccccagttaggagagttatctgtattgttgatgttgtcgatgttaatatcttcgattgtcaaaccacccgctttatagtgtctctgtacaacgttacactcaatagcatcgcctgtcaaatcgttaaagttgagacgggcaaaacgtgcgcgagtaacaagagcgcctgtaccttgctgaaggataccatatttacaacctctgaaatcactatccagaatgtcaattgtaccttctatagggagggcttgtagtaacatcgctgcggtgttggtattgttaacccatgaggagtctgtaatgatcagacgcccaccataatggcgagtacaaacacctgtgaaggtcacccagcggaatgtgctgtttgataaatacatgtatctgttgccgccagtctggttaaagcttccaccataccattcaacaccgtcgatatacacacttgtctcaagaacaaggttccatccccatgcaagaacagcttttttgttctcttttgcgtatgcagctaacgctgttacagcctctgtcgttgttggatatttccccatgaattgtgcaggggtaacaaaaccatcgagtgattgagccactgttcccgctggtccaccgataaaggttgagccattagcacctgcaaggtctccacgtagagatgggtcgttagctgaccacgccccttcaccaacaccacctgtagtctccggtgtggagtcggcaggaacaagtttcgggtatgcccctgtccattgatagatcctgttggttgatctgtcgatcacctgatctttgggggagacaagcgtccccccttcttggaaggaaaacaggcgcatcaacgaaacgggagaacatatctgaccatgttgatttacgggttgcatccgactggtcaacaaccaggtagtctccctcgaaagattccgtcgcattcggtaaatctgaaatcttgacggtaggtaatagatctgccattaattcctcttatcttgtaaggtttctgtacatagcgtacagtccaaaacctcttaacaattctccagcatggaagccaaagaacatcccattgtctgtatctgcacgaggagcaacagaccaacttccgttcatagggtgattaggggtcaggacgatgtagttttcctggatcaggtcaaaacaacgctctgccacaaggtcgatgtttggaatccttgtacccattcccgccattcctaacatggcgcaaccacccataaacaatgcagacatatgacttgtgaagtcatcaacaggagcaagaacagtgccatctggattaaagatggtcggagtccttccttcgttgttgtcttggaaccatttaaggtaatccacccagtttttggcaaccgtgaacaacttacttggaatagcctctttgcgttgagataattcataaatacaacggcaaacgcagaagaatgcacgagcttcataaccatcccaagccttctcattccaatgcttcattgtgaaggtgtttggttcaccatatttacgagcatcccatctatcccatacaaaagcctgagccataggacctggcatcacagggtggaatgtgttgtaaaaccacatctgtgagtcataaaggaagtcaatagtattgttcaatctcgtccagtcaatagccagatccttaaagcaatacagggtagggtattgataccccggatatggtaatcctcgccacccatcgtatagtgcagtgttcggatcactgatgtttgagaacggtatcagtccaggggtatagttcagactgttagtcctgtagtcaataattgtacaatcaccaagttttgcattgtacggattatcaccggaaacagtaatacgaaaatacatagtataatcgtcaccattgtttgaggtatacagttcagggacagcgttgacacaataccaatcaatctttgcacttaccccatcaaccggatcggtgtctggagctaagtttatctgtttcagcccatgaagattaatgtttgttggtcttggatcggtgtctgggtgatccggttgataactgctcaaagcaaagcttgcagtgttcaactgtagggttgtccattcaccattcgtagcaggcaataaagcccaccatctccactggttatcatctgtgattgaaatattgaaatcatcggcatacgagcgataagtaaacgcattcagatccgtagtctctgtatctgttaaccaaaatccaatagtgcaaccaccatccgcatctgtgataagtgtacaagcctgatcgttgatcctaccaagaatacctgtttggtattgaaagtcaacggttgtgttcgttccccaatcgacaacgattcgtggatcagccactatgtagttgccaccacctggtggggtcaacctgacgaaattggacagtggcacatccatagacacaatagagtctgtgcctcttggtaagccgcaacgataagttacacgaccttcctccgtcttcgttttgttcaggtcaagttctggtctgaataacaacccattgccaagatcgtccttacctgcaaactgcacacgtaattttgagtctccattaacacggaaccagatagcctgctgttcaagcgttgtctgtgctgccacattttgacgaataccaatataaccctcagagtctctggtgtatacagggactgctgaagatgggtatgagtaatcataactgatcccatcggtgaaagggattattgcaaatgttgatttgcggaagaacttatcaaagcggtcaatatcggaataattgtcacaaacaatcagagaagattgccagcacagccaatactttcgttcaccagtgatctgatacataacatagttggcatcacaccaccaagtttcagcatcagaggcgttgtcctgaaatcccatctcaataggtacgttgactggtcggttatgccacatcgtgttccgatccatcaagtacccaccatgctctacagggttgcaagttgcatagttgaatttgaaatttcctgttaccgtggtatctttgagttgaacagtcccccactccgcctctgggaaaccctcttcaagaatattaccgtcccaatcaacttttctgccgagtctgtcaatgatccaatcgacatcccactgagacccatactgatcccaatttgtcgtaccatctgcgttagcagcatatactgtggcgttaacggaattccatccaagattaccatcaaaggcgaaccaagccttgtcaaggtattctccccaatgtggagcaccatgaggaattaacgtcttaccatttgtccatgacataacgctacccttaaacccaccgtgggttgggtatccatcgtctgtcagtgggtaatgtgcaagccttggctctttcccgttaatgatccagttcgggcgatacactgccggaggatctgggattggctgaccagcaaagaaccagtcgatatatgcttgccaaaaatcttctgcaagttccagatatttagggtcgttggttgcaagatatgcatatgcgcaaccgaggatcaagacagactgaccctcggtagttgcatcaccgttaggctgggcttcttgagccgtccagttgataaagtgacggttgttagccaaaacattctgtaagttcaggatgtagtgctgaactgtcgggtcaatggtctctcccttgtttctttcaaggaactgtatgtgaccatcgatcaattgaaaaacattatcaatgttgtggcgtaactgtgccattactcaactcctgccataataagggagccgaaccaactattcccaccatcataagtgacgaactgaaagatgtctcggaccccggttttataagaaagaactggaacacgcccataattccacttaatattactgggccatgaaaccaaattcgcccctgtaccctgtgttaaggataaggtaaacgactgagatacatcctgagccgttgatggattggtaattatgacaacgcactgaccacctgtcaagttggcaacaaaagaatcacccctgttaaggttacatgttgctgtcccttggacattgccaagattgacaaccttacctgttgaaccgccgccaccactggcaccgaactcttgccaggcgttctcactgatgccgcctgtggttgacggggaagatgacattggaattgttttcgggtaaacaccattccatgtgtaatacttaccattcgtatcaaagaatgcaaggtctttcttggattcaaggaacccaccctcagaaaagaagacaaccttcataatacccatacgagtcatgatggtgtcaagagaagccttcctggttgtgtctgcctgatccataactacatagtcaccaccagatacggtgacggcggaaggaaggtcagagaccttcaccgttggaaaagaaacatctgccattattcaccccttagtggttacggttgatggacttgccatcctctgtggtgatgatattattcttatcatcaagtaaactaccaaccggaattgggttatccatatcagcaccagaccaagtattccaccatgtagcatcgccagtgcgaggaagacggaagttgatcaagtaataaagtttgttagcccaggtgatccaaccatcgtcatcacaaagaacggttgcaccttcatcaggggttgggtaataatactcgtcttgacctacaaaagcgagtcttaccacttcctgttctttggttgtgacttcataaaaggcttgataactacgggttgttctatccatagttgaatagaaagaggtgatttcaagaacgtcaggttcaagacgtgttacctccttgatcttattgtcaaggacagtcttcattacttttttgcttaaatatgctcggtatgggaaaccaaatgtctcatcgaaataccagttaccagcccaaatgttgaatcttagccacaggcgctgacgaaggctggtctggtttgactcgataagcttaagccccgaggagacatcaaggtctcctgtaactgggtccataaggagatctgagtaaagagttgccatttaaacctcttatttgttgggtgggttggtattaccagaaccaccatcatctgtccatgtgtagaagtgattatgacggacaaaccaatcatagaaatcattcatattcacaccacgggctgtaataaagttgccatctggtgtgacttttgccccgttcatttcaatgttcccatccacctttgcagtcagtgttgctgcaccattggtgaaggacatttgaccagttttatcaacaatgaacgttccaaccggaccagttaatgtgaaatcaccttcaggcgtcatggagaagtgaacttggtcgttccacaactcaacattgtttgggtctatagtcatggcgttgccatcactatgaacaccgataatggaccaccctggaaaaagtccgtgggtggtcgtatcattagcgtcaccttcattgcgctcagagaaggagagaccaacaacgtcaccaggcttcacaggaagcgtcaggcgagcttttcctccattagctgaaggcatggatagcgggacatcgaaaaccgcaggatatgcgtctacggtgccatcgtcgaagtttgttgaggctaagggttggacagtggcagaagggattgcgtaatccacatcaaccactcttgcccttagtcctgtgtggatgtcgcgagcttgccttgcgaaccattggttaagcgcagcatccatacgttgaattgatgccattattcctccactactccaccacgggtttctgcaagaccgatctcagacacccaatcaccaccctcaagttgccctttgtgggtcaggtacacaactttataaaaccctgtgtatttctgacttttcaggtaaatcgtgctttcaggaatgatcgcaccattaagctctgtcaccacaacaagacctgcgtcttctctgatctcggcacgacttggacctttgttggtttttggtttctttttggatttacttttcttttccagcctacgctttgctggttcagggttttgcggggttggtgaatcatgcatacctgactctgcactgatctcaaaaacagccgtcttaaacctcttgccttgtgttgtccagtaaactgcaccatcttgaacactgaatgttgatccagtattcttcgccagcctttcaagattgttcgcagcgttacctgtgaaagccattgactgctggagagtctgaccaccgaacttaacaaccttcccaattggtaatttcaagtctgagataaggtcgttaagaactgtatcaagaggagtccccttcttataagacctagcggtctttgcagtcataatgttggtcgttgcatcacccaggatcatctttgtttgtctggtgtgtccatcccatttatcctggacaaactcaacagtccctgaaaaaatcatctggttttcaccatcaaaccccgcctcaagaacaatggcaatagactctctctggttagcatcaagataactaactgtttcgtcactcaggttataaagcgtgacataacctttattcgggtctttggagttatccttcttcacctcaaactcgatgtttgcagcgcctgtttcgttactgacaacatacgcgttttttgtatcttggttggtataatcagagatgttcgttggtttctgtccaatataaacaggtttgccaatggtgagtctgaatgtacgtgttctgtaagtcggcatctgttaatcctcgtcttcagttacctcgtcgtcaggagatgaataaaggagttgcaagtcagacaagaacccgatattgtatctccccacacgtttggttgactgggtgaatgaaaagacacgcagttgccctgaaggaatgttttccaaatatttaaaaggggcaaagatgtcgaaaattgttgttaatttgaaagagatggttggatcagagccaacatccccaaatgaaacgagccaagattcatctctctcgttccactggaatctcatctcgtatgtttgactgtccaataccacacgcatagtttggtcagcaaaaccatcaatatcccatgagaatgtgatctttgacattatttacctaccgccttatcgtaatcaataatggagccttctggagtcctaatcttaccatctggggtcatcacaccaacaacttggtcttgcttggtaaagtttccagtatccattgaatcagcaattgcttgccatccatctttgtttgggccagcaaatttggttcgacgagcagtgacttcaacctcattgtcggtagctgaagactgcacagaccctttctgcttggttttaccaccagactttttagggtccgaatagattgtcgccatcgcagttttgccaaggatgaaggtgcggaactccgtgaactcaagctggaaaaccaatgcagcgccatcagagttgctacgagaagcctccatcgaggttaaaatgtaattctcgatgatcttatcttcagtcaccaaggtaacgatctgacgatcagtgataagtctttcgaggacctcaagtgccttttctgggcggcgtgaggcaaccgggttttgatcgtctgtatctttatcaatgtagttgttttggataagataaacaggagatgagttcacccttgcactgaaagaaaatttcccatcttcgatgacaccgtggtcactgaactttaccttttcttcaacagcgtaggatgtcttatcgaccgtccttgtgtaagagtgttgttcaacaacgtcgaaaatgatcgcgaggtcgttggtgtagttcttgtccttgagttctacgtttctaccgccgtagttcaaaccactggcgaagagcgtatattgcacctcaccgctggcttcttgggctgtgttgacctttttctcgacgttagccgtggccttaccctgttgcggtttggactggttgttggatacaaatgccatgagtcctcccattatacatgttacgattttatcataaatcttgagataaaacaataaaaaaggggccgaagcccctttaaattattgcgggacaccaaggattaagttgatgttccccatgtttgcagcttcgatctgctggtcgatcatgttcttcatctcacctgcatcaatcttgattgtgatctctccattgacaggttcggttggaatgaccataggagcatttcctgtcgggccagcaccaggcatcatcgagttctggttcaggtagttgagtctattctgatcagtcattgccctctgaccagtaataaagtcccaagttttacccatccacgagttcttgtaaagattaccacctgcggttgtatctgtgccgtatgttgattcactgtaatcttgagcttggtcgaagacataatccccggcaagcatactttctccagcaatcaacccatacagaccaagccaacgtgcagctttacccatcttaccgaagcgtggaccatttcttttcttcttaccgccgccctcgccaccttcatcatccccaccaccgaagatcgttgttaggaattttaaagctccggagagtccagcaatcttcgaaagaataccgaacacacggatcagagcagaagcaaagaacagagcaccaacaccccaccctacccatttccatgcagaggataactcctcgccattcttacggaagatcggaatgtaacgttccatgatgccttggatcagcacaaaggtattgtaaacggtatagaccatctccatgaacccggcagtgaacccagcaacgaattgacccagattttgagccaactccccgttggagtcaaggatttttgcaagttcgttgaacgcgcttgttaactcatccccaaatccgctctggaaaaccttgttctgaaagtccatccatgttaaggtcagtctctgcatcgcaacacggttgccctgcaatgccttttgtaaagcaccacctttatttgcagcctcggagtaatacttggctacaaaaggtaggaccttcgcagctttcaactcgcccttctgcatcatatcgagcatcttggttacgtcgatggtggaatcattgaaagcctcttgggaagccttgatgaacacctgtaaagatcccggaataccttcagcaagttgctgcttcagttcttccgccatgatctgtcctttacccatcatctgctggattgcggtaataccacgttggtatttgaccggatcaacctgtaaggcagtagagtattcagagaacgccttgaaaagttcatcgttctgtgatttactaagaacaccatccgctgcgattgccatttgggtgtaaccctgcgatgcaatcttgaggtcaagacccaagcggtaagactggtcacgaacaaacttcatgcgtttcccagcttcttcggagctatcagaaaccattagcatggtggcttccatgccctggaagaactgaccagctttaacaacgcttgcagcggcattgaatgcaccgtatgctgcgctaacgctgattaaagtgctacgaaggtttttcaacccgtctgtcagggtaagtgtactcgcatttgccttcttgagtccagtctccattgctgcaagttcagcacggaaatttgaagacttcatagtattactgtcaaggaagcgctctttcagagaatcgtaacctttcagttttgaggcataattgtcaccatatttagcacggaggcgaacacctgcgtttgcaaccgtagattccttacctgcaagataacgggaataacgctgatcctcagcttccattttcttacgggcctgctcacggacgcggagttgctctttggtgacttccttttcaactcttgttccacgttgcatctgacgaacctgtgcagcgtgtagttctgggtcgtaaactttgtttgggtcaccaaccatgcctgtagcatttccggcgttcgagcgttttgatagttgctcttggagagcggcttgacgtgcagcggaaattgctggatttgtgccgtaaccaccacctgtcttttccatctcacggagacgagcctttaggccattgtaatccgcttgagattctggagatctttttgcggtcagttgaccaacagcctgctttctacgggccttttgaattttgtcgattgcttcacgggcgcgagcttctttcttagccattgcaatagcatgggctgtagttttcgcttgctctgcacgttccgtttgttgtaatcttttgttgacaagacgtgcctgcattgcagaacgtcttaatgttgctgctggatcagtcttactggaagagaacgccctgccagctttttcccattcactcttcaaagacttcacagctttcatggcacgaccgaaagaagtcctgtccacgtcccatgtgactttgttgactgtctgggttacgataatattcgccattgattccctctcaataaaaaagccaggctcccgaaaaggaacccggcttgagattaacctcttctaccacggcgcggcctgtttgcagcttgattagcccttgctttactttcttcctctctttcgtggacatcagaaacgaattcttccacatcgaggtattcattcagcttgagcagataggccatatcagcagattcaagggagctataggattcccccttgaagtttttcagagcacgacaccataagtaatcgaaccaagtcagtgagctatttttctttgcataatccatagctctcaggacgactttcgaaattttggacggtgttactccgctgccacttccattgcctgatccaccgagttcacttgatgggtctgtcccaggcgtcccagaagtccctgaaggtctgcgaaaccgtctttcgtgaaaaaacagccgtagttaatctccagaactttagcaaccagcttgatgaggtctaacattttgtcttggaacagagcgtcaatatctactttacccgccataccatcaacggatacatcttcaagaatcaatgcgaaaagtttttcgagatcatcttgctccatctgttcaaagaggtatagaatagctgtagggagggcatcagaaaggttctggcctccagtcatcatggaaccagaaatggttgccattgggactgctacataacgaccgatcttcggaaggtttttcatgaccttcgttggagaccagtgcgtgataatgaagttgtgacctgcgaggtcgatttcagttgtcggtctgatattcatgtacgctcctgcgtctttgtggttgagttatccatgcgtgtataaaggccacgtccatgtggcacacgaaacacttaaacgataccagtcaggccagcaagaccgaagcctgcggaagacagagtatctgggcttaaccaagcatcaaggataccgatttcccagtccatctggcccacttctgttccgtaggtcaggtctggttgtttctgaatccaaccgatggtgctgagtcccataccctgagaaccttcaagaaggacagggaagaaaatcagtccggtgatagaggcttgtttctgccagtttgcaaagtttccgttccaagaagcagtgttctgaagggaaaccgtcatgacaccagattggttacgtgacagtgcggcggataactcaccatcaacccccatgtggggatgatgttatcttcgttacgggcaacgacgattttagtatctgcggcgaaaccagtcacacgctgggtcatcaggtacagtttgacttttttagggtcatacgcatacggcgttaggatagctgtatccatttattacactcctgctgttacagtctgaccgtttccggaattagaccctgttttatctaacagaacggtcatgcggatcttaacgaagtgcagtggcgtgttgtacacaagctccactttcacgttgttcagagtacgagcagccagatcgttagtcgggatgttcgcacgaagcgggattgtgatcaccggatcgtagaacactttgttaacgtcatcgtatccagtaaggatagacccgtttgcaataccaacgttgatcgggttgttcatcatgacagatttcaggttaggaagatcgtcatcactcatcttcatggagagacccatgttagaacggcgagacatgtatccaaacacactttcttctgtacggaatttcagccagtgaccgaaacgaacaacgtcaacgtagttaccagaagcacacttaccttcgtagaaggaaccaacaccgttaatcatacggtagaagttcagattctggtcccaaatggtcatgcgatcactcacactcagagttggagcgataacaccttccattgtcttcaggtggattgagtcaccataagaagggtcgttggaagccattgcaccgataattccaccctctgggaatgcgctatcagcaagaggatcgtacatgccgatggtagtatcgtactggagtgctttcagttggttagcaatggagttgctaccagcagtcttaaccagttcgtcagcagttgaataaacgtgcagcttgtagtttgcagcagcgaaagcagcagcaccaaggattgaagcgttggtgtgagattcagtgctcaggaagtaccagttctcagttgcagtcaggacttgtggcagaacagacgacacagtttcacttgaggagtttgtgattgtcatgttaccgctgtcacgaccaatactgaaagtaccatcatcttttggagcgatggttacaacgcctgcgcttgccgtagcagtcagaacagttgtcagagttgcatcaccattaagggctgctgccagggcagttgccagagagcttgggtagatgcaccagtcactgaaagaataacgctggtctgataagctccggaaactacgttcagagccaccgggttttcggtatcagtgtttgtttgtcctgtgaagtccacgatggtattggtaaacgcttgacgaccaatcatcaggtactgaggacggaatgtaccagcaaacgcttttgttgcaaaggtgtaagctggggaacctggagcgaatccatcatctacaagctgatcgagttcggtataagcgcgaaaacgttcagggaagacgttgtggatagccaggaacagcggggtttcaaaccctttggtgtcgattggttgagtaccaagcgtgactgtaacgtcaaccaccttgtcattataagccatcggtttcctcttctttatttctgtacatacagttattgaccagcacctctttgtgctgtattctgggggcttgcgccccctatacgatcactaataagccagtgcttatcaataaccgagtggttttctttagccttctgctgggtagtgataaacgagttgagcgttgatcttctccagttcttcgaaagctccggtatctgtttcgatgaagcacacgttaaatgtgatcaagacaacagcacgggtttcaaacttctgcatattcaatggaactcttaaacgagaaattgtcgaagaggacgagtatgcaaaaggagagttggttgggaaatatttgtcataaatgaacggtaggttcattgcttgcaataccctgcttaaggcgttgggagctttaccacggtaggctgtgagggtgtaaacaacctcataattatgcaccgtcatggcattgccttgagtatcaacaccttcgtcagactgccagtcaatctggtcaactgccgtcaggtcaacaagaatgaattcaccatccaccttgggaatctcatcttcacctgccaatacaacttttcttcctgtggtttctttacagaatgctcccactgtattggtaagggcgtcaaagatttcatccgaattggtgaatccagccattaaattcctccgttcgtcccttcggggacggatactacgtaagctctgaaacgggcgacacctgtagtctgataagcatcagatttaatcacagtgaaccacaccatttccccacgggaattcatcagcttgatttggtcagcaagctcgtttgagccttcaacaggacctttgagcatcacagaggaataaacggtgaaggagtcatactgtctaccaccttcctgcatcaattgtgatgtataatctcttgcagccttacctgttaatggttggacaacacactcaagaacatcaaactcttcatactcaatttcaacaccttggttttcgtatggattgcttgcgtcaacttttgaatattgtctgtgtcgccctgtaaaggttgggcgaggtattaatctattttttccaataagtctgtaaccagccattatgccctcgaccctctgctgttggatactctgaatgttgtggactctttaaggtcaccatagtggtacatcgcctcactgaatcccttgacatcggcccacgcatcggatactctgttatgaggaaacagaccggagtcgataacgaactttatctttcttgcacctgctttgccgatcttgtttagcatcggtgtcggattacgaccgcctgaagcaaggtatccgaaaagttccttctggagtttttccagttccttattgaatgcaactgctgcgcttgtcataaaggtacgggcaggaagaccattccaaccttcttgatggattgcagcgagcgttgcagtattaagacctgagtagtgagggtcgtcataataaccatatgaaacctgacgcgaatcaagttgttgggttgctctgaaaaagttctcaaactggctcagatcttgcttacttgtgaattttggtctcatagccacatccgtttaggtattttaccacattatcttagcaaaatcaacgaccaagcgaaggataattaacgaggccagcggtgagggtatctgcgaggaattcctggtacacctgtctggggtacaatgcctgcaacatcgaacggacctcttgagttcgggttccctttcacacgccagtgttcatcttgacggacaccaccaatgatgactaaactggaaaccgcgctgagacaaccgtccacataatcaggattggcctgtaaccaggtcaggaaatctgtccagttctggtatgtagaaccacctttcacctggattgtttcgtcaccgatcttttccaagcgttctgtgatagatgcctctccagagtttacttcttgaaggatcaaccaacgtaccacatcaacgagcgtgttataaacaactcgccacatgtcgcaggttgttgattgagggttgggccagtttgccttaaccttctcaatagcaagaaatgccagaattgtttcgtctggtaaaacctctgggggaatggacccaaggagcagtcgaatatatgcaataatatcttggtctgtcattttcgctcctgttggattgctcttctattaatcaatatcttatcacaaaatattctatttgtcattaaaaacacttgacaagacgttaagttctgttatctttaagtcatcaaacaaaactggagaacattttatgaaacatactaaggccgttatcattggaattatcgctggagcacttatcggggcgggagcttttacgtatgtaatgaagcatcctgatgttaataacatcaaagcaattgaatcaagttggttgtctcctgaagagaaaactgccagcgtccatcgacttgttcgtctcggttgcgaccaacgcttcaggaaagcattcaaacctggcgtctcagttgttcagacaggtaagatggatgagataacagaacaggctgaagcataccagtatttgaatgatgttgcgatcctttatggaactgaaggattcaaaggggcgtacatctgcacctattataaagacggaaaagaccccgtggtcaatgtgaatatggaagcaggtgtacgtaagcttctaaaataaaaggccccgaagggccttttgttacgccataatcccagcggatttaagcttcgcaagcagtccgttaaagtctgctaccagagtttcaacatcggttgctacagaatctgcctgtccagaagctttcttaacaccaccgagcgtggtagttgttgctgctggaagtgtgtaacctgcaccaccttctacgaggtcagcaacagagattgatttaccagtaccaacatcgataagtttggttgcataaacaagaccagctacaccagaagttgccatattttatttctccttataggaatgaggaaggtaattgcggaatattttcaacagaggttgcctgatccacactatcaatgtaagtccagtaagacttcatcaactcgtaatgagatctggatacgctgttgattaaagctgtcatttcactatgggtgaaatcagccttgtaaccatcgaggaactggaatggatagacatttgtggtttcagaaccatctgcatccaaaacattcttgatggttaacaaagttgcaagatcaaaactcttgacgcgaacttggtactccctctcatcgtaaggataagggataccgatgttaatgtccccgctaagaacagtttgtgcatcagcctttctctgatcttttgcagagacaaggttggccgcaatttcttcttcagtgaaatcacgtacatcccaagtttgttcccattcttgggtttggtcattgaaatgtggagcgccttcagtgaccacatccccttcaggcatttctttcggaattaccgggaagtaacctaactcgacaaggttttcagaatagatccaagaaccggtgctcacgttcggattatccgctctgaagtcagaaagatataccggatatttcccatcagacgttctgataagaggtgtatatgcgtaaactaccatttactctccttgagaagggggccgaagcccctttattaatcgacagtcaaagaggttgtacctgtcaggtttgtaccgtcccagaggatagtaacaaccgtgcgggtagttcccagagtaaccgctgtgccgtttgaccatgctaggttgccaggccacgtcagtgacgcaccggaaccagagaacacgataacgatggtcattgctctgtttgcaggtaggttagtgaagctcatggttttgtttgctgtaccgtcaaccttgaagacttgagacacgccaacatccatagccccagttgtagaagtaaccagaagatcgtaacgatcaagtttcttccacgcattgtctacacggacataatagcctgtatctgctggtgcttcaagtaccggaacatcaacccacccagcatttgttcgagcttgcggaatggtagaggctgtatcataaacgtttcctccacccatgtaccccagagaagcccatgcggtagcagatgttttctggaagtattccaatgtggatttattgatgaagtaatcaccaattcgcccatcagcaggacctgggttacgggagaagtttaaccaaagtgttccttggtctcctttaataccctggataccctgaataccttgtggaccctgtggaccttgtggtccaacatcaccttgaggcccttggataggtcccaagttctcataagtggttccagtccatccccagaaatctccctcaatcaagtatccctgaccaagctctccagtagaaggaagttcagtggtattgtcgagtttgccaaggatttctaccccagcacccatctgaccctctggtccttgtggtccttgagggccttctggacctgtcaagtcacccatcggttcccatgcggtcccgctgtaaacataagaataacctttgttcccaccggaagttactgaatacatccagccttgttctgggttttgaacatcaagcaggtcctcataagtcgcaataacacctttagcaacgatacttgcacccatcggtccttggtcaccttggataccaggatcaccctgtgggccacgcatgactccaagatttacccagttagtaccatcgaaagcaaaagcttctccagtgtcctctgtggtgtaaagatctccagttgctgcgccggacggcaaagctgcttgattggctactgtacctctggcagtcagtgaaacgcccattggaccctgtggtcctgtagcacctgcgggaccttgaggtccttcatcaccctgatcgcctttaggcccctgtgggccatcagccccagtatcacctttaggaccgacatcccctgtagccccggtgtcacccttgtcgccttttggaccaacgtatggacctacgtttatccattgagcatcagcctgactccagacgtaaaggtttggaactataatccaagcatcgcctggtgttcctgttgcaggaagatctgaaacagcgccttttgtcccaagaacacgagcaccataaccagtttcaccacgatcacccttcggaccttgaggtccttgtggaccgacagggccagttaaaccagtatcgcccttatctccctttggaccgataggtccttgaataccctgtggaccttctgctccagcaggaccctctgcccccgcaggaccttctgggccttggtcgcccttttgtccttgaggcccttgtgggccgacatcaccttggtcacctttaggtccttgaactggaccaatatcttcccaagtgtcgtcagatgtccaaacccaaacgtgattgtccgtttgaacaacccatgcatcagccacagcattaccaaattcaggcaattcgtcaactgttgcttttgttcccttcagttttacaattgcggcatcgttacctttatcgcccttgtcacctttaggtccttgaggccctgttaagccctgaatcccttgaataccttggtcacctttctctccacggtcacctttatcgcctttaggcccctgcggtcctgtggcaccagtagccccttgtggaccagcaggccctacttgccctacaggttgccatccgtctgcatcgccagtccaaacccacatctggtcttggatgatgtaggtatcgccttccgtatttccttgagtcggaaggagagatgtgtcagaaaatgcacccctgatcaccaatcctataccatcttgcccttgaggtccagcgaaatcgccaagatcagcccaagtgcctttcacaactgtccagtagtgagttccaattacgtaagtatctccctcttgcatggttgcagcaggaggaagttgggatgggtctccaataattccttggatgtaaataccaacacccggatcaccttgatcacccttgtcgcccttatcgcctttttctccgggagggacaaaaagaccttcttcaccagggtcggtcacttcaacaagaacgtttccggtcttggttgaaataggcacaacgatctgaggaggagcaacatacagctttccacctgccaatacaagcaggttatcactgagagggctaaccccgacagaaagtccgtcagggccagctacaagggcgttaccggaagcaggatctacaacaacagcggccttcagcggagtagtggagttaccattaccgagaagtgttactgtggtcgtatcttctgtgtggaattgtccatcgtccacaaaggttccaccgccagtaccttccggaaggataggttcagcgttgacgaccttatcattgtaatctgccatttttaccccttattttacaggctctaattcttcaagcgcagccttgaagtcagccatcatgttttcgaaagacttgtttttggcaagggtaatgcctttggttgcagcgaggtcagcaagtttatctttgctcgctttcttgtcagcttcgtcgttcagtgcttctgcttcagccagaattgcttcgtaaccagcagacttcactttcacctcttcagtcttgacttcttcacctttagggcctacaattgcctccactgccttaccgcgacgattcgggtttggaagaggactgttgaagaatacgatgtatgtacccatgcggagggtagagtgttctgcatccacatcaagtccagagatctcggcaagcgccttgaagaactcaacagagttgcggaaagccctttgttcagtaccgacacaaaagccgttcagaggaagacgggcagaaataccaacattcagatccggtgcgtaagtaccgaagaatttgaacaattccaccttgttagggaaaatacgatagttttgattagccataaaatctccatttggttaccttagtaaaaaccacttgacaccgttgatgaagtggctattattaaggcagaaaaagaaaaagggagaggtgaataatcacctccccctcttagaggtagcagttacgctatcttatgcgaaagtaccagtagagcgaacaaccagttccggacgggtgttaacagtcaggaaggaagtttcggactcaactttttcttcacgcaggtatgcagaagatttgtaccacaggtacagttcctgtgcaggagtgttcgcttcacgaacgtcatctgctggtgcatagtgaatctggaacatgtcgtcgattccttgcggcagaatgtaagcttcaccatcagggatgtagttggagatatcctcgatgtaagttacgttcttgtgaacgaacatacggttgttggcgttctctgctccctgacccagacgacgacgaagcggctcttgagtagaagagtagtattgataagcgttcattaccagcggatgagcgatcagcgctgagaaccacttacgagaagccagaactacgataccgtagttgttgccattgtcacccgcattgtcgatgatgtaagcacgagcttcagcttcgagaacgtcagtcgggtcgattgcaacattggtgaagtcaatgtttgcagtgtgctgagtaacaccccactcggtgaagtagttgtactgagcagtcgggtcttgtggtgcccaagatttacccatgatcgcctgaagcattgctttttctttcagttgttcatgagagatgcggatacgacgaaccacacgagcaacaacatcttctacagtcttcggagcgtcagtagtgaaatacttacggaagttctgtacgtctgccggagtgatctgacgatcaagtgggaagaacgggatgttgaagtttttcagttgggccttttcagtaccaacgtagttacgttcaccctgacgacgacgagccgggaagtcggttacaacttcgtcaacacgttcaatctgagcgacagtcgaaacaccgtggtacgctgtgaacaggtccatgttggtgataagacggtactgacgtggtacgatttccagagttgcgccaagatcgacgatctggaagtcattagagcgtactactgccattgttattctccttggtgtagattagatagacgttactgggatctcaacagagccgtcgtaatatttatcggtgatcttcagacctttggcctcaagagcagcgatagcggcagcgttgattgcagtagtaccgtcagcgaaaaacagtttgaatttgttcagggtcagaccacgaaccgccacaacgaagttgtaagtagtaccaaccacgaagtcacgaggagcatcgtaagcaggaaccagatcacggtcagtgattacaccgaatgcgtcagcagcagcggaagcggcaattggttcgccagcggcgttcacaatcatacctgctttcagaccagctacgaactcaatcggcatttccaggaagctgtagccctggtcagaagagtccactttacccagaacgatgtcagagtagtacccttggattggattagccatttatttaaatctcctcgattaggcgtttagtgcagcagcttcacgagcgcgagctttcgctttctcgatgttagcctgaaggatgtcttcggcagacttgttgatgtcatcaacagttgcttcaccgtcttttccgtgttcagcagtgccgaactctttcttcacggtttcaacttctgtttccagttcgctaatacgagcttgggctttttccagaagagctactaccggagcgttagctttttcgatgatgaaatctgccagagaagcgtggtcagcttcagcagcaaaggtgaaaccttgtgctttagtcagagcggctttcttttctacttcaacagcggctttgatgatttcatcagcagcagcagctttagctttggcatcttccagttgcttaaccaggtcaaggtattcctgagacttggttacatcagtaacattatcggacactgaggtctccttattttctttggatgtatcaattacagggtcagtacctgcttctttgacgaccccagtcacctggagatcttcggactcaccttcggagaaggtcagacctaattcgcttactcccttttcaaacagttgctgaagcttcagaagttcatactgtttaacaaggtcgatttcttcaccgctgtgcgctgccttggcgatagagattgactccatacgcccttccagccattcctggtgctgtgcgttccaagcttggacccactcatcatcagggttttcagcggcctcattttcaagttcagtttcaaagcccagcagtttggcaagcagttctgcatcgtcgctccacatatagaagaacttacgcaggaactcttcgaaactcatggaaacggtaacctgttgcagcgccttgataacgtcttcggtaatctgttccggtttcaggtcagacttcatcagaagtgatactggacggaggtttgcagaaaacccttgactctcatggcagagtgcgatacctttttccttaatggacttggcttttgcaattgtcattcgccatcttcctcaacatactcgacaccgaaatcaacgttggtgatttctcctgttgctttgtcgattgatccggaacactgaatgctcaggccaccaacaacgttggactttttaaggtcccacagtacagggtcgttatatttaactttagctacccaggtgccagccttgattacttgctcggtcccgataaccaccacatcaaattcttcctgaatccaagtcttctcgattgtgaaagagtcagtctcaatcatgtggaagaggttctctttaacaatgccagcttcgtttgccttatcaaaagactccttggccttagcgattgtctcagcagacatccattcgccgtgagcgtccttggcatctggttcgtagataacttcgtaagaaatcatctgctcatcagcgtctttctggatgctcacaacagaggttgacttgttgatttcagtcttaacattcattttgagaatgtctttggaagccttctcgatagcggcttcaggagattggcctgaagcaatcaggccatttgcaatactcagtaccttgctcttctgaacgagagacagatcagataccgatgcaggaaggtcagcaatacttgtgtatttcatcattttccccgttgatagttattttaacaccgttcattttcttttgcaagctatttcagtaagttgaaattaattatccatattggatacggaattgtctcttgtggaggagatttttcctgttccattaccgttagagcctgctgtcataccatcaccggagcgactggtatcctgaccaaggagtttcagaagttcatcagttgacatgtcttccgggatctcttcgtcaaagccaccaacttcaagaatcttgttgataactgtaggagttttaggaagatacccaacagcaccgatacgctgaacgaacttggagaagccttccatatcgacttcttggataaggcctggtttcagttttggcatgtcttcgtctgaaagacggatgtcattcagtgccagaagctgagggatcaggttcttgttgaaagcctcaacaatgatgtcgatgtcacgctgaacgaaatgtccgtggatggactgcttcgattcagataagttgtaagacccctgaccatcgttaccaaggttgatgaatccagcgccaaatctgtcgaggattgccttcttacgagagttcaccagttcctgtgtactgtactgcttacctgcaccgtcaatccctttaagagacatcttgtactgttcaccaccctgagcgttcatatctgaaggcaggatgaagtaggcttgctcacctgcgtgggcgtttgcagcatccgccatcaatccttgaaccatttctgattctggtgatttcgggtcaatcgctgccttgttcaagatctgagaagggatcttgagttcgatgataccaccaagatctttggaagcaccaattgtttcgaggttctcaatcagaatcttttcacggaaagcacggtaacacccaacaagaggagaaacaccagcagggtttgactctgtaccaccaagactcatcaccatcagtttattgataggaatgaacacttcatccgcagaggaggtcagattagtaaccaggctcatagcactggagatttgcgtcagaccgttctggaagttggcaaaggccatcttactctggtaaatccctttcagggtgcgcccatcctcatcaaaaacccaaggttttgagcgagaaagacttgattgtggcctaaaggcaatcttatcaatggtgatgtacccagcatatttagatggggcagattcagtacggtacaccttctcaaagatggagaatccatactcattaaaggttgcggcactacgagcaatatcgcgaagagtttgctggttggcaaggttcttcaacgcgtattctacaaactcggctgcatctttggatgccttactgtcacgattatacaggactttgaaatcattgaaagctttcgttacgaaaacatacttcgtatcaagcgccgtggagacagtatggtcctgcttcatagcctcgacggttgccagaaaacaaggccagcgtaactcttccaccttcataacttcggattctgcacgaagctgtgaaagagcaccagaacctagttccccggtacggagacgactaacagccagattttcgtttccggctttaaccacctccgatggttgtgcaaatcttgttgacacgagttatcccctctgttatattctcttgtacaaggtcggagcaacaattttcgggataacaacaggtctgacgatctcgttcttctccaagtaattaataccggaggcaacggcatccgcccagtcatccttacgggttgttgtgcttcgctcaccattaaacttttcaagttcagtcattaaggcttcatatgtcttagcatcgaaactgcttctgacaatcctcaccattcctgactgagcaagttttgcaaaaggagtgaagcgtgtaagttttgatttattccctggcgtcgggtctctctcaaccacaaacccttcagccagaagctcacgagcgctggttgtgaactcactaatgcctgcttgaccggggtcaacgctgaagatgataacaacatcatccccatcgtaatgggcttgctttttaatgatcacatcacgttcaccagctttcttacagaaacggccttgcgtttgagtggagtattgaccatcatcaacaaactcagggcaataatctcctgaaagataataaaacccatcagagtctttacttaccttcacagatgcagtaaagtcagggtatctgttaccagatgttcgttctgtacctgccttgtcgtatggtctaacggacgtaacgcccagtggtaggcaaggaacttccttgagataggatcgctggaaatagttcgcaccttctggacgaactttccagtttccgtggagtagctgtgccttttcaatttccggaagaccctcaaggaaagcaagataatctgggttgttgtcaagcatcggtgggttatcgaagatagtcgcactgatgaatgagaaggaaagtggttttggcttcttacgaatgtccacaccgtcccaatactgctcaataagttcctctgctgtatctccccagatgaactcaccgtcacgacgaatgaaccaacggataatcccgtctcgctccgcaatagggaaaccatcatcgtcgagataccactcaatcaactctttaatcttgtggtctgggtccgggttacatgagatgaccatacggcttgggtatttggattcagaacgaagacgagacatgaggtattcgatctgagaccattcaaactgtgttccttcgtcaaaaccaacaaaggtgtactgtagaccctggtgagaatacttatctttctcgtattccatgtgggaccattttactttagcaccagaagggaaaattgcttccaggtctttctccctgaagcgtggtttccattccggatcaagctgtgtataaatgcctcgtgctgtatcatacagaccaccaccacccttcaactgaggggtgtttctacggaacatgatgcagttcgttcgtggatcgtcgatgatatttaacggcattaattgaagcaggtaggatttacctgaccccgccgcacccccaatgatcaggatttgtgcgttgttttccaggatcattttctgcttaggctggcaggtccgaatgttttactcaaaagacctccatattaaaggcgtaatttggcctataggaggtagtttaccacgaaacttgataaaaataaagcccttatcacgaaataagggccttgtcaatcacttttgcggattaaaaatgttacggacgtattgttgcagagtccttaacttgctgcggtcgttggcagcattcaggttgttggtcttcatgatcgcgctgttctctgagtttgaagcaccatacttcaggggagttggctccacaggatcaaccattgcagcagcaggtggttgtgcaagaacctttgcaggatcaaacttctcaactaccggaacaacctccggcttcgcctgacaaccgaccagtagggtgactgccatcagcactgccattaatgctttattcatttcacccccaagctttcgttgtagatgtcaacaaactggttgtcaagcccttgcttcttgcctgcatcagacctgctgtaagcgtcttgctttgcgttaagctgtgcctgcaattctgcattttttgcctgctcttctgccagtttcctttcaaggatatcgcttgcgatctgttgttcatccttgtaagactgattctcatccttgttttgctgttgcacatccttccattttcgatctgtatcactcacccctgaattgtaggactgcgtgatctgctcgttataccagtgctttgcatacaatcccccgccaacgaggacagcaagcaggatgaccactgcgattacctttagattgcttttcagaaacttcaaagccatttcaatttgtatcatgagatttccccattggtatcaattacccgctcgattttgagcagagttgtatcttcatcttcgatctctattgcagcatcattgtaggcaatcttggtagggtcgctcacagacacctcaagaaggacagcgccaggtaaagaggttttttctccccatctaccagttctgcctttctcaccccaactcttgtatacgttcaaggcttcctgctcgtctacataaaggttcatcacatcaaggaaatcttgtgctggtttctcctccagaagaccaactttgtgcctttgctctacagcttgcatcaggtagaagttgtcagaaggacaaactccccacagagttttaaaatatggccttccagtattctttcggaggcgttggtacatggtaaagatatttacctctttaagacctgtccaaccacctttaccacccttctcagagtcagttgcaatagcgctgatgattttatcaccagcactatccagtttatcaaataatagctcaaatgaaaatggcctttcttcatcgaaaagctcttcaacgttcgtaccatacataccactcaggtgggccttggcatcttcccaagtttcaatgctcaaactagaagctgcaatgccaagcttcatggtctcccggcgagagattgtataaccgcgagcgcggtacttatcagcacgaagcatactaataatcgggtaatctgtcttgggattcaataccaaaaccttctgagcgatgtgcttcatgaaatttttgtcaaactcccactgctcttttgcaaagctgaatgaccccatattaatcgtaaagtcaaacttatcaaatatcttctgtgcatcagggaaaacatcaaaagcgatacattgcagaaccgggagcttttttattggtaaacatgacacttttatcggtcataccgatattgtcaatgttgtcaatcttactctctttaaccgcttgggtgaatgccttaaaatcctcatcagacatatctttccagatttttgccaaggcaacaactgacaggcgtgtcatcggtttatcttcagatttgatcaccagggtattgacataatctttaaagcttcccggatcgtcaagttccctgaaatatttgaatgaccgtttggaattgccccaattattagtcgcctctgtcaggtctgattgacctttcaagaggctacgatcagtcatgtacgcaaggaaaacttccaggttctcccatgaagggaagtaaaggtctatgtcgtttacttctcggttggagaataaggatgtgagtgtaccacccgcaacacggacatcgaggcgtttaaggatctccatcaacccgtttggaataaggctacggaggatcaggtattcacgttggtattcttcttttggaaagatatgaagcatggttttctcctttagtaattaaaccattggagtgtaccagaaaaagaaaagccccgcaatagcggggcgaggcaaaggagaggagattgaatatttattattattagaataagaaaagtggcgaaggaacctttactcgtcgagggtgtcttaccgtttccacagccgagaccttccttagtgtccacttagttatttggatgcgtgagcgggagtcgaacccgcaatcttcggcttatgaggcaacatgatctatatatccgtttcactaccacgcaattgtttggtggggccgggtggactcgaaccaccgacctgatccttccaagggacccacgctgaccagactgcgctacgaacagattgtgtaagttttaattgtcccagagtcttacaactggtatcgctggctaggtaataagttctccaagcaaagttttaatttgcaaggaggatgtttggcgaggccgaaggggatcgaaccctcattttccgcatagacagtgcggcaccattaccttgtcagccacggccccataaatttggcgacgagtgaaggatttgaaccttccttgagttttcactcacggcttaacaggccgtcgcccaaccactaggccaactcgtcatttaactactttatcagctaaaacaatcttttgcaagagttattttaactaaattaatatggtgggtcgggtggattcgaacccaacgatctctcgattaaaagtcgagtgccttcgacatacgtcaccgcttggctaccaacccatatttggaggagagcaacagaatcgaactgtcaccgtatcgctacgatgggtccgggttcaaaccggattacgcaccatgcgtcctgctctccggaggaagatgtcagacttgaactgacacacccctttcggggctactgtctctttagcaaagagatcccttacctgattagggttaatcttccactcttactaactttgcactaccatgcccatcgacttcaatattggcgtagtgatactttactattttatcatccacaatgtcaataccaatcactaccatattttcatcatttttcatgatctctccaaatcgagttgttctttaatctctttacggagatccgctttttcttttgcacgagtaataggtatgctttgaatctcatctgcaacaccacagttacttccgtggatcttgcaacgaccaaacaccttcttacaacgtaaaagcttctgcataatatctcctaaagtggcggtggaagtaggatttgaacctacggacccctgttaaggggccgacacctttccaagatgctgtcttaaaccgctcgaccattccaccaaattggggtgacctgtgggtatcgcgcccacttcctcaacgtcacaggttgaacatcatctcataaatgcttaggccacacatgagcactctcaaaagaaaatgttcaaatttggcagggggtggaggattcgaacctccgatgtcgagttcaaagcccgatgcattaggccagctatgctaaccccctattggcgtgaaggtgaggaatcgaaccccttacgactggttttggaggccagcttgcagccactgcaattatgttacccgcacaatgtttggcgtcctgtgcggggatcgaacccgcaaaccccaccttgaaagggtggtgactttaccagtttgtctaacaggacatatttaagcgtcatatcggattcgaaccgatgccaccgacttggaaggacgggatgctggaccgctaacactaatgacgcataattttggtgggagtagcaggctttgctcctgcgacctctcgattatcggtcgagcgctctactaactgagctatactccctttgttttggtggcccaccctggattcgaaccaggaaccccgaagggcacggatttacaatccgctgcaatcaccgttctgccaatgagccaaaatctttatagcggtggacgacgatcagcaaagaagctgatgatccaaaccacaatcgctacgataaatacaacttttgcagcccaagctgctgttcctgccaatgcaccaaatcccagaactgccgcgattaatgcgataacaagaaacatcaaaccccaattcaacatattagtatcctcatattaagatattttggttaaccattttgtttgaaaggaacgatgtcggtagtgaaaggttttgatggagccttctccggaaccttattaccgtcatcaacgtttttagtttcttcttcactttcattttcttcatcgaagtaatcagacatcatttcttcgcctttttcgatgacgaaacgtgcaatgttctctctgatgttgtccttggtgctggaattcatcatcaggtcacgtaaaacctggtgtgcgtcaggaatcatggcgatcatctttgtcttcaggtcaagaagattcttctcaagctggattgcgtttgactcctcttttaaaggacgcccttttccacgacgacgctttgtaagctgttgttttgctgccataattaaccccactcattcatattatcagagatgtatttctctgtcaagggttattttaacataattcactttaaatttaaagtgttggagcacggtagaagaatcgaactcctgacattcggtttgcagccgaagctgttgccactccagcaaccgtgcttgcgtggacccgattatttcaattcctcactcacattcgggtcaagatgtgacacatagccgatcaaggcgcttcctctgtctcggcgtgatcgcttcccggacagtcatatgaatttggtcgaggtggctggattcgaaccagcattgagcggtttagaagaccgctgcctatcccttagactacaccccgttaattctggtgcaggtgacgagactcgaactcgtaatcatttaagcgggagattttaagtctcctgtgtatctccatttccaccacacctgcaatcatcgttcctgaaataagatacatcaaaatcttttccaagagcaggtccaccgctttgtatatgcttaccatatttccctgagcaagacctcgaacaaaaaggaccagattttttatcagatctgttcttcctttgtgattttgacaatttaaaggtattaccacaccaaagacagttgcaatatatttcctttgctcttagagcgctcttttctgcgttagcctttcttgttaagacttgcagattagagatgttgttgttattcacatccctgtctatgtggtcaactgtttctaaatctggatcaagctctcttccaagatgcatctccataagatactttgggtagcttcttgtcatttgcataccgtcataaagatagatgatcacatgttgcctgccatcatccctaacatacagacctaaaacttttctaatcttatcgagatacatatgcctctaccaagttggaccaaggacgcaaacatattttgagttgcatggtgactccaccgacctcctttctccgcgaaaggcgctctacgaccctgaaacttctgttacagcaacgtggcctttgtcactgaaactccattccgttaggctcattctccgcacagatgatcagtccgtggttcaaataacctgagctaatgcacttcaaaatatgctttggagccgggtgacggaatcgaacctgtgcttatcccgaatcttgggactgctctaccaacttgagctaacgaggaattgtttggtgctcccagtaggaatcgaacccacttcttcggcttaagaggccgctacactaaccgctgtgttaataccccgaatctggcccgtgtttttcaagacgttgcacgggatcgtcacggttgccacggccctttattttaagacgcatcgccgcagccagcttcgtctatccccatgccggaggaattacttcttcttacctttcggcgctacggcttcaacaaccttagcgtctttagctttaccagcgcgttcacgcttggtcttgccagtgcgaacacgatgtgaggcagaaatgacctgaccaccttcaacgcgggaaactgattcccagatagatacaacgttgccatcttcatcacgacgcttcttacgaatagaaaccgtctttgttacaccgcccagacgaacatcatgaggggcagagtgggtctgcgtagacttggactcaaactggaacggctgtttgattgcgtcgattgcagaaactttcttgtttgcgtttttcttagccatgttttatttctcctctatttgctaatgtctcgttgacgttggtaatactaaactctctcacttcctttgtcaatcgttttttaaatcttttttcacttctttatgaagaccgagtgaaaggtcataacgatcatatgtatgaaccgaggttgccttgatagaatcaaatcggcttttccatgattctgacatacttggtttttcaatgataccaaaaaactcatatacacgtttcattgcatctcctgtttggtagttctggcaggaattgaacctgcgacctcttccttatgagggaagcgctctaaccaactaagctacagaaccattccgtcttggtgagatgaatactaatggttaaagaaaccattgtcaacacctaaaatgaaaaaaagcaccggatttttatttccggtgcttctggtattacttgcgatatgaagtcgcctggttgtcaagacgctggttagctcgtgcagcgtcaccgcgaacaatcagaacatcctgcttcatcacatcaacgtcagattgcagttgatcaactttctggttgagagttgcaacatcgcctgacagtttttcaagacgctcagttttgtggctggtgcaaccagttactgccagtgtccctaccagaaccgcgccaagaatagcctttttaaacattttatttctcctgggttatgtgcagcagtagtatctgcatgatctattttactgcaaaaggtcccaatttacttcaggaaatgtccgaaacagaaacattctgtttacaaacattgcaggtggttaccttctttggacccatgaacggaaggccgcacacatcacattcagtgtggtaataaaaattacggaatgtatcagtgggccagtctctgtcgctcaattcaaagattgagtcaaaggtctggtctttcatcagaagaaataccctctccgaaacctacgaaaatatctacgtcttcagcctggcgaatgccttcaccgtaaccaataaatccgtcaaattcgtctttcatctttttactccttttcgctttgaacgtgtaatcgccgcttcagcacggcgctgcttgcggtttttatactgtccggaagattcggagagcgtacttgattgtggaatcaccgtcaacggggtagaaatagtataagccgccttcttctccgaaggatgcaacgtattgccatgcctcaatgccaaagccagtcgtagaaaaagcgatgtcattagcttcttcagtcgcttcgtcaagggttgggtggtgtgattcgtgctcaatgtactctccattatctgatttatgtacaagctttaatttaaacataatgacctaccgttaagttgttaagaatttcgagttgattcgatagcttagatcttatcagtggtcactatttttgtcaatcaaacaatccctgatgccttgacaccacgacgatattctgctagtgctaacgtcttggggtcaagctcttcctcatcttccttcggattatcaatctcaaggaaatgttcctccagaccatcaaggatgtccggctcccacgccttcttctggtctgtgtgtacagatgcacgattgaaatcatgacgactaactggatttcgcactcaatatctccttttctctatctcgccaaaatattgcatcatcaaggttcctgaatgttttatttcgtttttcagttccccattttattgtcacaacataatgctttcgtttttcaacccacgttatgttaacatgtccagtgtttgaagatgcagtgacattcctattattcatttcgcgtgttgctttcttcaggtttacccacgcattgttggtccttatcctgtcatcatggtcaacaaattcaggcatttctccagtcatatagagatatgcaagtctatgagccaagtatagttttccatcaatacgtattacaacataaccgtgctttccaacgcaagaacactctgttccaccaaggcgggtagcgtcttcctttcttgaaaaaccctcttttaaccatgtgaaaatgcctgtctgcggatcgtaatgcaaacgggttttgagatactcttgcgttaaactacgcacaggattcctcttccaaatcaatttttcctgttttagtgtttacccacactgttttatccttgctggcgttcatctgatgaccgcagccaaaggaaatgatgcaaacgcctgggccgtgggcctcaagatcagcttcaaattcctgtttacagactttgcactccatcattactggtccaaacatcttaggctccttaatataatacgggtttgttggtgtgttattacacgtaaggcaatctcgtactgggacttcatgccacttgcatggattttccatagcctacctatcagaaaagcccccgaaggggctgataatttaaagctgagaagctgcccgatcacgaatctgtgtcaggtcttcgtcaatcatcaactgaccgtctcggaagacacaacggagttcgttatcacgagactgtacctcatgcacctccagattgtcaaccagttttaactgattgtcttcatcacgaataaccttcaggaaaccttttgcagatttcttaccgaggtcagtcttcggctctttgacaaccatgatctgcttgccgtcgataactgcacccgttgctttcacagccatacccagtgaatcacgagttgtgtactgggttgtgtaagaaccaacaccgtacacgatgttactcgatgcaaagccacgatctttcagtcgttcaaagatatcttttgcacgagcaacagtgatagagtcaccgtagatcaggccgacatgactatcaaggaccttgtaacctttagagttgacttcaccaccaaagatatcccacaggcactcgaccgcaccttttacctcgtgctcttcaagacctgaaggctggaaatcgaagaaggcgttatcttcatcgtcaacaagaatgcggtagtatttaccttcaatcttggcaacttctgaatttgaatcttcctgcaatgcagtatgtgcatcagaccagtcatcaaagtcacccaggttacgataacccgcgatgatgtgctcaggaatgcctgagtcagggcggaacactacacgaccgtcacgagcaaggatttcctgtttcaggatcgccgcagctttggtgataatggcccagaaatcataactgtctgccacataggaaacaaaacctttcgggaagatttctgtgatataacgcttcaggaactcgacttcagcaaggaaacgcgcctcgtccagagacagttcagggtgttcaccttgcagacggccaacaatgaaaccaatatttgtggtcgcaacggagtgctcagacgccgggatagaaccagctacaaaacgacccttcatgttataataacggttcgcatacacaatcgccgggatagtgtcagtacccatagagttgatcagttgaccaaattcactctgtgctgcgtcatgtgtcccaccttcaccacgatatgcaaaacagtggttctggaaaggaacatgcagattattatcacatgtttcagcagcccatttctcagacagtttacgatattgccagaatgttgttgcagttgtgattgttttccaggtttctgctgacatcacactttccaggaagttcggtaaccagtaaaaatccggatgggtattctggatagtgaacattggaacctgcaccggagccagagtgccttctggtaaagcacggatttccagaggtagataaccaagatcgtgtagcttctcaaaaccccacatttccaccatacccggtccaatactcagttcgcaaatttctttataatctgaaatcgcttcttcctttgagcgtttgaaaaagttttcattaaacatatcgatcaggaaccacttgatgaatccctgaataccagcaaacatcacacggtggtcattgtctgcgaagtggataaagtgctttgcgttacgggcggtcatattgtcctgaacaatttcagaacgtttgtcatacatcgagatgtgactcggtttgtaaaaatcagcgaaagtaatcgggctttctttatgcagcatgtttgtttctcctctgtgaaatttgtgggtgcattcttgcacccgttttatactatgtcaagaaattttagaagttttctgtccagtcgtgatatgcataaatttcatctacaccaccatcaagaatgacctgcttgccgaatgagaaaataccgtgtgttacataaaggataacacgttttgcaccattctccttcaacgcttgtgcaagggcgatgaatgtgcgaccaccatcacaaatgtcatcaacgatgacacattcacgaccagtaacatccccgaagacagcagtacctgtgatctcgttagtttttacatcacggaccttacctgcttcaacaagcggaagacggagatgttcagaaaccttctgcgcttttttacgtgctccggcatctggtgcgataatcgtaacatccctaccagcaagtacatcactataggatgctgcaagttcatgttggtgccgaatacgaacattgttcagaagtgcagcagaaacatcactgtgcgggtcatctacgataaccttatcaaacccaagtgagttaacgatgtttgcaaaaaccttgatggacaatgcctcgccaggttgcataacacgatcttgacgcgcataggggatgtacggcaggtgaaggacatactgtgcatgaatatcaatgttatcaagtcgagagcaagcatctgccagcagagcaagagccataacatccgcagatgtcttgatttttgctgtgatgtcaacaaaaccaatgtgaccttttggtgcataacttaaatcgatcttaacctgttcttcaccacccttgaatgtaaggcgatcaacagggactatcaggttgttcagacgaagttctaaactcattttatttctcctcaattatttgaatagcctttaaaatatcttgcttgtggattgtctctgtgaagccgtcaggtaaccaatctttttcacaaacaaattgtgggatcgcactcaacacaatctgctcaactttggcagcttcagcataacttttgaacagcttggagtacatcagtttgtgctgaaacaaacttttctttgattgttggcgcattctttcgaaaacattaaatgctataccaacttttccgattgttaagcctgggcctgcaagctcttgaacataaacgtagcaggttctttcaaattttggatttgtagaatcaccaaacgaaatactgtactgaatactctccgctccactgtcagagatggcggttttcttctcgatccaacccttttcatacagagaagagagtgacctaccaacagtggctctactcaaccctgtggagtttatgaaatcttggtaagtataaaccccaacaccattcaaccccataaacatcaaaagaaccttttcagaagcacttatctctttcgattttataacttcaagcataacatcctctatctattaacaattatgtaatgccttggttttgcattccctttagaatcttgaaaaccagagcgtatgcggcgaatgtatccaagatactctatctttgtcaagaactctgatactttcggttgtgacttctcactcaacccaaaaagatgacacaaagatttttgagatggaaagaatacctcatcaccaccatcagggtttaaactcttgaagtaatcatacctccaccacaattttatcaacctttgcaaatcttgtggtgagagacggtcatcaaaaagccactgtgtcgggatagtgacgtaagagccatcccttatgttcacagtgttatcaccaatctttatctccaccaccatctcctatttattccagaacagatataattagaatgtacaccaacgtaacgcagatgtcaacctaattattcccaatcgggaatgtctaattattcccaaaaaggaatacaatactaacctatcaattaaactaacttatgatcttttaaaatcaaaacaataaaacataagatctatataaaagatctttaagtatgatctatatattctacagtcatagagccagtggctcagttgggtcagttgggtcagtatggatgaacaaaaatctgttgtcaagagttgacttctcgttttgttcatgtacaatgctcctatcgttttagaggagagtgttaatgttgtcaagtaaacaagctaaagctgttggagatatggtgtgtggtaagagtcgtcgtaaggcgatgcctacagatgaagaaaccacacgattgatgatggtacgtgaagtctttcatgaatgcaataaggatcagaaagtttgtgtggtgttaccagatggtaaatctgcacaggaggtgtttggaaattactacgactctgttcgtggtcgtctacgcagaccaaatgtggtggtgactcagatgaaagacttgacagtggagcacatcgaaggtaataattgtgtggtggatctgagtgagattctcataacgctctgagagcctctctgagacgttttgttggtgtggtggtacacttgggttcctcacaccattttaattcaatacagggccgctcagaggctctgagggctattgtggaggattattttgaagcttagtcacatatctggtgaaaaatctgtatgcagagaggcttttatggctctcaagaacatcatgctgtcgctgaaaagcggttcaatacaaaactgtatctcgacagccgtgtggatattggtaagtcgtggttggagtcatgtgtgtacattcatggtgatcgaaatgtcgtcaacttggtgtgcttgaagcttattacttggcagcacaacaatctgccccgtggaaaccaataccttctgtacgcataccctgcggaggacatggacaaatgaaaaaagacatcaagaaacctgtaagggaaaaattcgatacaacagcttttgttttcaatacaaaggttgagatcatcaaagaagccattcaacgcttgcacgatcaagaggcagatcctaacgcagaaccacttacaaaagatgaaatttactggctggggtggtgggaactaaacatgcctgaactggaaaggcgtggactcacagaggttatgacgtgcgcccaagagaacgccgctttagggctgtataagaaaacaacgaaaaggaagaaaaagaaatgactaatatcgatcatgtaacatcagatacacattggtggcataccaatattcttggtttcccatcctgtgataagttccgtaaaaacctgtacggaccgaaagaagattcagcgagtgttgtcaagatgaatgacgacatggttaaaacatggaacaaacatgtgaaacctgatgatgttgttgcacatttaggtgattttgtgatcgcgtatggtaagcatgtggagccgaaggttcgtgacattcttagccgaatcaacggaaagatcattttggttggtggcaaccacgacaaccacacgacaaagcgggtatttcgcgagtttggtcacgaagttgttgactataaagaaattgatttcagcacaggaaaagaaaaagttcgggtgtgtatgtcgcactacccgtttgcatcttggaataaagcacaccacggatcagtcatgctccacggacatagccacggctcatataaggcacctggtggacgaatccttgatgtgggttgggatgtccacggtcgtcctttgacgatgcttgaggccgtttctgagtgccttaaaaagcctatttacgatattcatcactgaggagatggtatgcacaaccaaaaacgcaatttcttgcctaagaaaacatcaaaatctttttacgccacaatacatattgctggcagttacaaccaggcggaaaatctttgccgacactgggtgatgaggggagcatgtgtgcagatttccccttgtacttatgtttatactggtggtgtggaagacggtatgactgtgcgtatcatgcagtatcctcgttttgagcgaccagaacatgaaattcttgacatggctgttgaacttgggacatacttggctcaggaattatgccaggtaagcttcagtgttgagacaccgtataatacaacgtattatcaggcagatggttatgaaaaaagatcttagctcccctcttggtatcaatgactctgatataattacacagagggttgttgatggaaaaaggattttccatcctgtatatcttaagtggcgaaatatgttgcgaagatgtcttgtaaagcacaataaacaccaatattatgaaagtgtatcagtatgcgatgaatggtattacctttccaatttcatttcgtgggttggtgatacggatgttgctggcctctacttggataaggatatcctcggtgacggaaaaatatactcaccagagtcttgtgcattcgtaacacaagaatgtaatcaattcttttcatctgttaagaaaaatggcaagtatatgataggggtttccaaagaaacccgccttgcggacacattttactgccactacaaaggaaggtatattggtagtttcagaacagaaaccgatgctcataaagcttggcaaattgaaaagagaaatcatgcaaaatctcttgcaatctcagaacaggatgttagaataagacaaaagctgcaagatattattgcaaaaattgaatatgacatcctaatgggagaagaaacatgctctttaacgtagacgatctggtcgctaaaaagctggtcaccaagaagacttacactgatggcccgttcgctggcctatcagttctgaagtacaaaaacaatgtcttctgggataatctgtggaacacagatccacgtctcctggaatgccgtggcatggtggttgattcggatgacaatgtggttatctggcctttcaccaagattttcaatcacttcgaaaatggcacagaccttccggcagacaaggtggttgatgcagttcgtaaagttaatggatttatggcatccgctggtgtgtataagggccagcttgtggtgtcaactacaggaactctggaatcagactttgcagttctggcgaagaatcacatcattgctgaatgcaatgacattgagcacttcattaagtggacagaaagtgcaaaggcgacgttcatcttcgaaatctgtgatccatctgatccgcatattgttgatgaagagcctggggcgtacctgattggtgctcgaatccagaaccgtgacggcacaagttttatgctgcctgaaggtgctcttgacggaatcgcgaatgttactaaattcaagcgtcctgaagttcaccagatggttaaattttcagatgttgttgaaatgtcaaagcattgcaaccacgaaggttatgttgtgcgtgagccaaactatccgttcagcttactgttgaaaatcaaatcccctcattatctggcgaagaagttcttgatgcgtggtggtgataacaagtgggatatgatctgggatcatccagacaacgcaaagcagcgtattgatgaagagtattacgaattgcttgaccatattcgtgaatactacaccaaagatgcttggtcagctatggattcacagcagcgtcgtaagatagttgaagattattttacgatagaagatctctttgaccgtgggagtcgtttttatgttggtgtggctcgatgacttaagggaccccgttaattacgggcatccagatgccttgtggataaaaaattcgcaggattttattcagtttctcgaaaatcggtcaaaaccatatcgtcgtgtcacggagtggcacttcgataacgatttaggcgaagagtctgaacacgatggttattggtgtttccttgcccttgaggaaaagattgtcttcggaaagatgttgtttgggcctgttaaagttttcgtacatacttcaaacccttcagcagggcataagtttatgcttgcaaaagatagtttggcacggtatggtgtaaccattctgagaaacaattactgaggagagggtatggaaaagacattaatcatccttcgtggggtttctggtgcgggtaaatcaaccgttgcagaactcctgaagaatgacagcaatgttccacattacgaagcggatatgttccactatgttgatggtgagtaccggtggaagcaggaaaaccagcacaaggcgcacgagtggtgccagaaaaacgttcgcctggcaatggatatcggttatgatcgcgtgatcgtttcaaatacctcaaccagcgagaaagaaattaaaccgtaccttgacttggctaatgattatggatatcaagtagttagcttggtggttgaaaaccgtcatggtaacgattctattcacagcgttccgcaggaaacacgagatgctcaagagcgtcgtctgcgtaactcgttgaaattacaataggagaaataagtgagacgtttgattgttatttctggtgctggtttctctgctgagagtggtgttcgaactttccgtactgatgagtcaacaggtaaggcgttgtgggatgaatacgatctggaagaggtttgcaatatccacgcattccgtggaaacttctaccataaaacccacatgttttacaataagcgtcgtgctgaactgccgactgttcatccgaacctggctcaccttcgcgttgcagagtggttccagcgttatccagggcaggttgttaacttgaccaccaacgttgatgatcttttggaacgtgctggtgtgccgaaagaggatacggtctacattcatggatacctgaaggaaatcattgtcaaggacaacccgaaaggaaagccggagattattgatgtaggctataacgaggttgatcctgatcagtataaatggtgtaagcccaatgttgtgttctttggtgaatttgcaccagaatacagcaggatgtatgacatccttgacacccttaccaatgaagatatggtgatcgttgtcggatgctcaaatacagtcatcaacttcaactgggagttgtttcctgctgttcgtagaggaacaaaggtgcttgtggtaaacccacgtatcaactatcttgagcaagagcagtatgatgctcatggtgttatgcaattccgttgtggtgctgtagaggctttcagcaacaacaatttcatcaagattgtggaagatcatcttgaatgtaagacagcattacaaggtaaggagaaataatgtcgattgctttagataccccaacactgtacgccattaacaaggacggatcttatcaggtctggaatgttagaacagagggcgatgaggtagttgttgagtttggtaaagaaaatggaaaggtacagcaaaaacgtaccaaatgtgaaatgaaaaatgttggtcgtgctaatcaaacaactgctgcatttcaggctgtgcttgaagcgcgatcaaaatgggagaagcaagtacgccttggttatcgtgagacaaaagaggcgttacagactgaggagaacttctctcccatgctcgcacacgatgcaattaaacgttcaaaagcattagtttaccctgcttatgtgcagcctaagcttgatggggtacgcgcccttgtaactcttgacaaagatggtatcccagtatttaatagtcgcggaaacaagacgtaccctgttcaaggtgcattgttgcagcagacaaaagaacttgcagagcatactgggtttgacaaatttgatggtgaactatatattcatggtctgagcttacagaagattgttgctctggctaagaagtggcgtacacctgagcagatcgaggttgagattgaaaaggattaccaatcagatctgaaacgctatcagaaagctattgacaacggtgagcaagtatggaaagattttgatggtgatgaatacgatgtaagtattgaaccggtgaaagatgttgaccgatatggcggttactcaagtttggaccttgaatatcacattttcgatattcctgtaaacgcaaacagcccgtggcattcagagagccatgataaaaaccgactatctgatcttgttagcgtgatgtattcacttgattgtgaggtcaatgcaccaaaaataaatgttgttcgtggtgagtttgtcctgaatgaagatgcggttaagcggttcattgggcgatacatgcaagagggttatgaaggtgttattatccgcaacttcaaaggcgtgtatgaattcggtcagcgatcttccgaccttcagaaatggaagctgttccaggatggtgaagcgaaggtgttggactctgtggaggacaaaaacggtgagggcgttctcctctgcgaagaaaaagacggaaccagatttaactgtaagatgaaggggacgcgtgaagaacgttctcaagcgagaatgttacttctggtcggtaagttcatcaacttcacattccaagcaaggactgacgacggtgttcctcagttccctgtagggcagagtgtacgagaagttgattcattaacatgggagcctgtatactgatggcattttataagagaaaacctcaagaagtggaagcacatgtgttcaatggttcgagcacaggtgttggtcaagtgacaaagtggatggagactggtgtctggaaagactcagagattcacacacgagacatccgtaacatggatgtgaatgggacccaagcttttcctggtgattatatcgttaaggttggcgaccaattccgtgcaatgtcaccacaggattttagcgacctgtatgaaccagtcacagatgaagaccgtctgcctggtgattacaaggcaaagaatgtcgtaatgggtgacaaggttgaaatgtggggcaaaggatatgttgtcaaaggtgtgaaaaccagaggtgacgatatgatccttgagcttgatgatggctcaaacgtcccggttcgtggtgataccacagttaaagtaatcgaggtacgtgcataatgatctggtattggctggcgctgctgggcgcaacactggttaccgggggcgggatttatctcgcctaccgtctccggaaggataagctcgatgacttcctggattggattgaaggtaaggtcaaacgcctgttgttaatctgggcggttgttctgggcctggtaacgctggcccttaccaaaccgttgtggaacaccatgacctgtcagttcgacggtatggcctacaaggtaaacacgtcttactcttggtataagaatgggacgtatggagataaatgcctgttcgtagcaaagaacggagcgctgctgccattaagaattattcgtgatcagcctgatggtgatcatgcttcagatgttgttaattaaggagaataaatgaacttcggcgtaacttatgaaaccctactgtcaatgacaaaaccgaaagaccttgttgaatatggtcgtcatgtagcccaatggaaccatattgctcgtgtcgctcgcggcggtaaggctactccgattgatttgcaattctctttcgttgaagaagaattcaaagagcttgttaaggctcttgaagatggcaatcgtatcgaggttgtagatggtgcttgcgatctctttgtcgtctcgtcctatgctttctggttgcttgaatcttctggtattcgttgggaaaaagcaatgaagcctgatgggatggtacagttcaacattggtgagatggtagaactcattttcaatacaccattatccattgaatctgttcgtgctgttcttgagcggtctgtagcgttatgctatcgattagatattaacttggactacaatatgcgccaagtgcttacgtcaaacgattctaagtaccctacaatcgcacaacttcgcgatgttcatccaacccttcatctgtacactgatgacgagttgctgactgctgaatgcaaggagattgaaatacgctccaaaggacgttacaactctgtaactgctgtgcgtagtggtgaacatattgtgttcttcgatagtaaaggcaagatcatgaagccaaccactttcgtagaaccgaaaattatcgcttgacaataaagagggggtctatataatggaccccatcaagacagagaggagaaataaattggaaaaagattttgacgaagtttgcaaggaactgttagaattgtcaaaacgtcttaatgttcaaatcgttatcggcaacaggccgacattcaggccgaagcaatatatgatccgcttcacaatgaagcgtcgttggggcggtgtcaagaagtacgcttatgaatgcactctcgaaaatctgaagacgtatgtagagcaaatcgagaaagctggcggaaagattatcggtatcgaataaaagtgtttgacaaaaagatttaaatagctatactgaactgactaaacaaacagaggagaaacaaaactatgccacgtatgcctaaaatcaaagtagaactgaaaaacaccctgccttctgacgctgtagagcgtgagcgcctgaaaaaagttgttcaggaaggtgttgatgcgaagatcgcccaaaaagatgcggcgagccagttcaaagacatcgttgcggttgagaaagacagccataactacgacccgaagttcatcaagaccctgatcaatgctgaatttgaccgccagtatcaggcaggtaaaaagcgtaaagatctcgaagagcaggttgagcagatgaccgaagctgatattctgtttggtcgcgggagcaactaatgaaatattacctgaatggtgttggactttttgttttcttgtgcttcatcttcgggttcgcagtaccgactctggtttcagcaaaggatacacttttagtcatgggcggtttcgcccttgtattctccgccccagttgttgtatggtactggctccgaaaggtgtttattaaacgtggaggggttaatgctgctaaatcttaaagcgtctacgtgggaaaagttgcaggctctggcccgttccaagaataagtctgctgcttcttacgtagcaaagattgttgatgagtacgttgacgaaaacgtaaaaactgaatacaaaatcaaagaggagaaccaaactaatgcttaagaatatcaaacgtgtactgtttgctggcctgatcgctctgggtgcaattggcctgactggttgcgaacgtgccaccgtgcctgcgggttacgttggcgtaaaggttgacctgtatggtgacgaaaagggtgtccagcagcaagaagttggtgttggtaagtattggttgacctggaacgaagagatttatcagttcccgacattcaaccagttgaataactacgagcagccgttcaacttccagaccaaggattcgatgacggtatccgctaaaatcggtgttgaatactttgttgatcgctccaaggtcacgaagattttccagacctaccgcaaaggtgttcaggaaatcactgatgtaaacattcgacagaatatctcggatgccttgatcaaagaagctggctcaatggacattggtacgctggctggtgatggtaagagtcagttgcttgaacgtgttaccaagcagcttaagtccaagcttgatccgattggtattgtgattgtaaaactgtcatataccgatgacctgatttacccaccgcaggtaacagcgtcaatcaacgcgaagatcgaagcaactcagaaagctctgctgcgtgagaacgaaatccagcagaccaaggctgaagctcagaaacagatcgaagccgctcgcggcgaagctgaatctaagcgtctgcaagctcagggcgaggccgatgctaaagtggcactggcaaaaggtgaagcagaatccattcagatgcgtggtgatgctctgcgtaaaaacccggagatcatgcaactggaagccattaacaagtggaatggcgttaccccggtatatatgaccagtggagcacaagccccgttcgttactctgccagcaggtaagtaacagttgacaaaaggcccggtgatgattatcatcgggtctcaacatataaaaaggagatacaaaatgatccgagtaaaattcttcatagcagtattactgctctcttccccggcattcgccacagtcaacaccctcaccttggtggacgaatacaccgatggaagctccaaagtctgcatttacagtgatggtaatcgcacagaatcctttgttaaggatggcgctggttcttgtccttccaaaaagacattccactgaggtgattttatgaaaaagttctttggtctgcttctgttttatgcttttacgatgttgttggggtggtatactggcaccctcctgttcgcatttttcacatggacggccccggtgttggaaatccccggatgggctttaagggttggattcttatgggttctgggtattaccgggttcatgacatggaggggcagaaatgagagtaacggataagtttgttttctttttcacccaatacgatatcttcagtaatcattatcgctgtgccaatcctttctggattccaaagcaccaagcggttggtgcaaagttctggactgtagaacacttcatgatgtatgaaaaggctatgctgtttggcgatacaaatatcgcggttgatattgctaatgtttatcacccccaagaggctaagaaacttggtcggcgggtgaagaacttcgacaacagcaaatgggaagcgtttcgtgaaaatatcgttgtgaatggtctttatgccaagatgatggctaatcccaccattaaggatgcggctatcaagcttcgtaaagaaggcagggtctttgttgaggcatctccctacgatgcaatctggggaatcaagatggctgagaacgacccaggagtagaggacccaaccaactggaaaggtcttaaccttctcggaaattgctggcacaaagcgattgaccgagtaattgacactatggaggtgcattgaaattagagattgaactggttcctaaaacagcttggttcactaacttacgctctcacctctctaagtccaattgggatgtcgtaaggaagaaatgttatgcaaaagccaattataaatgtgagatttgcgggggaaaaggaaccaaacaccccgtagagtgtcacgaaatctgggactttggcaatggcaagatcacgctaaaaggtctgatcgcactttgtccatcctgccacgaagtcaaacatattggtttggcgggtattcgtggtaggggggaaatcgctcttcgtcacttcatgaaggtcaatggtgtctccagacaaattgcagaacagtacgtgaaagaggctttcgctttatatcacgaacgcagtaaacgggaaaaatgggaattggatgtccggtatttggacgagtatttgagtaacgattgagagggctagtgggatatccgtatgataaagattggaaaaataaagtcacgaatgactgtgtgatcgctttagaccttgaccagacttgctttgtgtctgccgctggcgctgagaagcgtacaattaaggcaactcacatcgcttctggtcggtcaaagatctttaaaaacagaacagagttctggggttccaccaagaaggtggttggcggatggttgaaggaccagaacgccaatatggaagtgaaggcgaaagctgaaggccgtgagttcaccccttggggaagagatgacttcttaatcgaagatattcaaacccctgaaccagtggaacactgcctgcatatcctgaagacaaagattaatgctatctttgaacatttgggaatggacagcagcaatggccttggtgtgctcggcggggacaacaacttccgtctgttgttaccagcaccggaacgttacaaaggaaaccgtgaagacacccttcgtcctttgctgttgaaggaaacccgcgagtatgtcaagaagaagtataatgccaaggtcattgatggtgttgaggcagatgattacctgtctgttctgatgtataccggatgggaacacttccaggcgactggtaagttcaactacatggttgcgtcgttcgacaaggaccagaaaggaacaccgggtttacttcttgatacgatgcgtgatagcgaggagaaaaactggaaacacccgatcccgatgattatcgacgattctatgggtgagatctggatggaaggaaacaaggtcaagggatggggacgtaagttctttggctaccagatgctttgcggggacagttcagacaatatcaagccttatcaatgcttcgatatctctgggcgttttggagatactgctgcattcaacctgatcgggcatcttcagaacgagaaggaaatgtggacggcaatcgttgaccagtacaagacttggttccctaatggggttgagttcacctcttgggatggtttacagcgcaagatgaccgcagggcaatgggcttcaatcatcttccagatggtttacatgaagcgaactgccaacgaccatactacgctcacaactgaacttcgtcgcgtgggggttatatgattgataagatgatcatggatgctgtaatgagggacacccaggccctctccgtgtcctctctgaagccaaaattcatggttggaacagggctgtggagaatgctggaaacagatgatggggactatgttgtcttcacggatgacttccttgaccctgataaggcattcactgtgcttcttctggaggattgtgagcttgtggagggggagagattagttctcctgacaagcgtggcttatggagaccttgagtgttctctggtgttgttcaaggaccaagctgtaggagactccgatgaagttgatgtcggttgaccaaagcctaagtcactgtgctgtcgtaatatgggaacatggagttcccgtttacagggaaatgatcaggacaggctcaacacacagtaaagggaagaggcagaaggatgttgtttattttgacaacgtttatgagcaaatccgttatattgtgaacaagataacaaccttggcagaggagcacagaattgaccactacgtcatggaagccctcagtcttggttctatcggtagtgcaactcgtgatttggctggccttttttactgcattgtgtacgcattgtaccagtttggtattttagggtatggttcaatccacactgttgcaccaacatctgtgaaatcttttgcaagaggtcttttaccggaagaagagcgcacttttgtgaaagaaaaggttgacaaaaagacaggtaagaaggtatactcaacgggccaagtgaagatggaaaaatcgcatatggtcagggctgttgagtgcgacatgcctggctggttagacggtcttacgctcgcggctggtaaggcggattatgcggatgcgtatttgatcgggaagaagttcatggagggagtatccgtagaaaaagggtaaggagtcctgcatcaaaacccaaggcaaggaagaaacctgtcgtagtgccattgacgccaggactttgggtaaaagatgcaagacaaatcgctgcattcagggagaaattaatccttgagcaggggggtcttgatcctgtgcttggggagccacttcgcaaaccttgcttggaccatgaccacttcgatggtaaatgtcgtggagtcttgagtcagtgtgtgaacaccttcgaaggatatgtgctgaaggcatggatgaagtacgtgtctgcgtacacagatacgtctttgtccacagcgctccgaaatcttgctgactatttggaacaggattttagcgggttccctatccatgctgcgtacaaagacgatatgctgaagttcttgaggagatgtaccaatgacaagatcattgaaagggcggagactgacctcggcctgatcatccccaaaggtactcagaagcatgatagcataacgctttaccttacagagtttgtcagacaaacggaggaaagatttgctggacaatttgagcaagcccctgaagttctattacaagaactggcggggtgaatacggttatcgaaccgtgatggacccgattatgtggttcggttccacagagtatcacaaagagccgcagtggatgatcaaagcatacgatgttgagaaagatgccatccgtgactttgctgtgaatgatattgttgaatttatccgagaggtgtaatgctgagtgcagaagaaatccttgaattaaaagcgaaaggtatgagcaaccgtgaaattgctcgtcgttatctggggaaagagagtaaggaatctcatatccgtctgatcctgaaggcgcaccagtatgatgcagaggctgctcaggtgatcaccgagacagttgttcgcaatccgggcgcgaagatcttccttggtgacgtagaggtatcaccaacgctcgcttgggtctttaaccgattcaaggcgtttgtaacaccttcccacgtagaacatgagccttatatgtacacatgggcgggtaagtggttggataaccctgcgattatcagtcgcaagctgccggattatgagacgttcaaaaccgatatccacgacgaccgtgaactggttgaagaactgtggcatatccttgatgagtgtgatattttcattgcacacaacgcacgtttcgacaaaggatgggctaaccaacggtttgctttccacggtatgaaaccgccgtcaccgtacatcgtgatcgatacacttgcagaactgaagtcggctttctccctgccgtccaacgctctggaggccgcgtgtaattacttcgagcttgatgcccgtaagcgccatcacgaagggatcaccttgtggattcgttgcttccacggtgaggttgcagcattcgaagaaatggagttttacaacatcggggatattccgacacttgaaggtatctacttgaaagttagacctttcatgaagaaacacccgaacgtgacgctttataacgaagaagacgacaacactgtccttcgctgcgttcgttgtaactctgataaggtactgcctatggaaggtaaggtggggacaacctacctgtcaaaattccaggcatatcgctgtgaatgctgtggttctgttatgcgtgaccgtcgcaacatccgtaccaaggaagagatggctaacacgcttgtgaatatcatttaagggcttcggcccttttgcaaaggagagaagaatgagtagagttatcagcatcaaagtccctgactcgtttgataatgactggttgataaagcagcttcgtgatcttgacatgcgtctggaggagttggttgaatcggaatctgatgaagagcgctttaataagatcggggcctgtctggacatcgttaacgctatgcaagaatatgcggggtactgatggatattatcgttctgaatgcaccgccgttgagcggtaaagatgacatctccacctatctgtgcgatggtcacccaaacctgcaccacgaggaagttaaggaacttctgtttgaagtggctgtaaggactgctggcatctctcgcgacctgtgggatgctatgtacactcgtcgttacaaggaggtccccagtccctacctgatgattgatggtgtgaatgtatctcctcgtcagtggatgattcactgctctgagaaggtgatcaaaccactcttcggcaagtctgcgtttggcaaggcagcggttgaaaaactgaagcagaattatgcgaacgatgaggttattgttttttctgatggtggtttcccggaagaaatccgagagctttctgatcacgcttatgcaactggtggtgagtttttccttgcacgtattcaccggaaaggctatgattggggtaacgacagcaggaactggttataccttgacggtattcgaggtcatgaaaaagacttcgataacaaagagggtaagttgactgactgcgccgaatctgtccttgagtgggcgagatcaatcagctatggagaagagaatgcgtaagccacttaacatcggtattgatgtagacctaacgttcgtagattcaggcacaccctggcttcaatggatggagcaggtatacggtgtaaaggcagattataacctgccggatataaacccgcaggggatggattattataatctgtcaaaatacttccctcctgcgaaggttaatcagttacctccgtatgagttttgggaagatccgtacctgtacgacaaactgcgtccccgcgccggggctgttgatgcagttgcaggttgggcggctgctggacacttcaaccatttcgtgtcttactgcaagaaaggccatttctcgtccaaggtaagattcctgaaacgagagacagaggagtttttcagcattgaacctggaagtggtcacggtttttatgcaacaaaaaacaaagctggtattaagattgatgtcatcattgatgaccgtaatgagttcctgaaccagtttgggccagaggtgattaagatcaagttcaagacaccttatgaccaatctgaagagcttcgcgtctctctcgatcttgagagcgatgactggaacgtcatcaaagacttcgtgctggatattgcttaatgaagagatgccccacaggagacttcgttgtccactatggggattgggtggaggtattcaccgaggacggaaccttcctcatatccttcaaagcaacaagtgacatgtgtcaggacatcctgacacgatatctggtgtttaaagccgggatggacccggaaacaccttaccgaatcaagaggagaggcaaatgagtcttaaaccagaatctttcgacatcatcaaaaacgaacttctgcgtcgtgctgaaaaaatcccacaagtgctcggccttgatgctgtagggatcaatgcagcagaccttgggatcaccgaagatttcgtttcccgtctgatcactgaggcataccttggaatattcaccaccgacgaggttgaggaaatggtagccttccagcaaaaattcgcagatcgcaatctcattcttgagaaagttattgagcaagcatttgctaaagttttagaagaaaacaaagagtcgctgtataagaaactggaaggagcacaataatgaaaaaagctgtagttgcccgtgttgtcgcggatagtatttcaccgcagggtcgccgtattacaacttttgagcttgagtaccctcgtatcattcacagcgaactgatgactcaccgtctgttcagtcggaacgctatgagtagccgtgcaatcccgatcaaaaagatgatcgagcaggttcagacagaccctgcaatgccagttaagtttggaaagaatcaaccaggaatgcaggatgctggtgagcatgacgcacagcttggtgatgggtattcggctgaagattggtggaaactcgcaggattaagtgcggcacggtttgcagcagaattcgcagatgctggttaccacaaacagatcgcgaaccgcctgcttgagcctttccagcgaatgaaaacggtcttgacagcaactgactttgagaatttctggtggttgagggtagataaggatgccgatccaaccatctacgctttagcagaggccatgaaaaaggaatttgacgaatcagtacctgaatatctgaagccagggcaatggcacaccccttatgttgatcacctatacactgtaggagagcaggcaagtgaagacacatttgattactgtgttcttgacgagaacaacaaaccagtgatcttgacagtggatgaagctaaggctatttctgcatcttgttgtgctcaggtgtcttatcgtgtgcttaacaacacgaaagagaaagctttagacatttatgggaaacttttaagcggtaataaggtacacgcttctccttttgaacatgttgcaaccccgatgaaaggtgagttcagccagtacggttatgacccaagcatcaatttggcggaatacccagtttcttgggaagaaggcattacccatgttgatcgcaaaggtcgcctatggagtgggaactatcgaggctggattcagttgcgtcaattactgcctaataactatgttgaaggttgatgtagctggatatgaagggatttatcaggtagatactgatggtaatgtttggtctcttgaaaggtgggttgagaaaactcgccacggaaaaagaacagcgccacagtttgtccctgcaaagaaaagaaagtgttctgagcatggcacaggctatctgactgttagattggcaaacaacggtgttgtaaaaactttcagggtgcataggttgattgctgaggctttcctacctaacccactcaacaagccatttgtgaatcataaagatggtgataagagaaacaacaaggtctcaaatcttgaatgggtaaccgagaaagagaacactgaacatgctatagaaacagggctgaagcctgaaaatctgagagatcccatgactgggcgttatgtgagcgaacaactggaaataacgtagtttctggttgacaaagtttccagtaatacgtatcttggatgtatgaattgcggggagaaaatactccccgattataggcagaatggagattacatgagtaaaacaaaacgcaaaccaacccaacatatttcggtcactttggactttctgagaaccgtacccggattcgatgtaacccaagatagtggactccgtgctgccctttatgcagtaggcttccaagtcaccgatagtgaagggaatcctaagcaagtaacaatgcttaacatgaaaaatgtacgatgtgcgaatttgccctatacgtaccgtaaaacaacaatctttgttggtgacatgcgtccggattatccgtatgcaaaaatttataacggtgttgatattctcgacgtagggatttactccgagcgcgacatggagttcgttcttgatctcccatacgatattccagtgaatgagaaggttaatacccgtaagtacaccaaacgtggagatcgtccagattcgtttgatattacgttcgatagtgaagatgaagcacgtctcagtgacgcatttggtctgggggaataatgagtaaagagaagaccaagtggaaagaccgtggcttcgatgacaagcatcactacgccgggtggctctacttcaatgatttaaccgatgacagcaagatgtacgacgatgtttactatgatgagtattctggtaaaatagttaacgtcactacgccgggtcaggatgataaaccagacgaagacgttgacgaagctgataagtatcttgctcaattcgaagaaaaataaggagaaagtttgatcaatacagttgtaaagagtgatggaaccaaggtgccgtttgaaccagaacgcctgaacaaggcagcgatctttggtgatgacggtaatggtaactggtcacatatctctatggacgcctacaagcgcctgtatgatggttgcaccactcgtgaagtaaaccaagcattgatcgatgcctgcgtgagccgaaaagacgaagcccattcaaggatggctgggcgagttctgatcgggcagatctacaaagaagcttatggcggtttcagcaagatccctgctctttataatttctatcacgagatgattgagaagggttactgggaagacatgggttatggtcagatggagttggtggaacttgagagtgtcattaatcattccaaggaccttgactacggctacgccgtcctgaagcaattccgtgacaagtacggtatcaaagacaacatcaacgatgttctttttgagtcaccgcagatgatgtttatgggtattgcgatggcggtaatgaagcgtatgcctcgtgatcgtcgtatcaaggatgtcattaagctttatacgtatctgtcggatctgaagatcaatgctccgacaccgtatctgaacggtctccgtaccggacgaactggatatgcgtcctgctgcattatcaaggctgacgatacagcgaaaagcattggtgttgctcgtgaagttgcgtatacgatgacagttgcacaggcaggtattggctactacctctcctcccgctcaattggtgacggcgttcgtggcaatacgatcaaacacatgggtaaactcccatattaccgtggcattgatgccggggtgaaagaaaaccgtcagtccacccgtggtggttctgctacgatctctttcctggcccttgacccgcagatcgaagaactgttgcgccttaagaacccgcaaacagtttcttcaaaacgtattaacacaatggattactccattggtattaaccagtcgttcatgaaccgtgtggcgaagaaccttgactggatgctggtatcttacaaggacgcacctcaactacacgaaggtatgttcaagatgaccatgcaggaatttgatgcagaagttgctcgtgtggcagcggatactaagatccctaaaacttgggtgaaggctcgcgatctggcactagagatcattacccaacgagcagaaacaggtcgcctgtacgtttactggcctgacgagatgaaccggcacacgcctttcctggagacgatttattcctccaacctgtgccaagaaatctgtctgcctaccaagggatacaaagatatgcgtaacatctttgatacctttgcagacgatggtgaggtcgctctttgcttcctgtcatctctggttgctgggcgtgtttctccggaagagtacgaggatgttgcttactacaccgttcttatgatcgacaacgttatggatatcatggattatccgtatgagaatatggaacacactgccaagtctcgtcgttcaatcggtgttggtttgacaaaccttgctcattacattgcgaaacacaaggttgcttacggctctgctgagagcaagcagttggttcatgacctggcagaactgcacagcttcagcttacataaggcaagcctgcgtcttgcaaaagagcgtggtgtagctccgtggatgaacaagaccaagtacccacaagggtggttgccaatcgacacctacaacaaggcagttgatggagttgtgaagaatccaagtctcaagcaggattgggaaactttacgacaagagattatcgaagttggtggtatccgcaatagtgtgttggaagcttatatgccgaacgaaagttcttctctggcgacgaacactactaacgggctttacccggtgcgagatcacattatcttcaagaaatcaccgcaagggtctgtgctgtttatcgtgcctgagtatgaagaactgaaggattactacacctctgcgtgggatattaacaccaacgacctgattgacatttacgccgtcattcagaagttcgcagggcaggcgattagtgctgacctctacatcgactatacccagttgaaagacggaaagatctcgatgaaggaccagatcggttacctgatccgtgcaacgaagatggggatgaagacttggtactacttgaactcgaaggttggtgctggcgactcactcaccgcagaacttcaggcgaagaagcaagcagaggaagagacccgcaaggattatccactgattgcagacacctcggttgaagacccgtactgtgaaggttgtgcattgtaattcttatggggcttcggcccctatttttccggaggcgaattaatggcagtattcaacgctgagaacaccgctcataaaactggtgattatccgctgttcctcggacagcaaatgggtctgtatgactccatctacaaaaaatacccagccctgtttgacctgtacaaggctcaaaaggaacaggattggtctgaagacgaagttgagctaaatcagtcaatcactgactttgcaacctgtagcaaatccacgtatgatgtcatggttcagaccctgatgtggcagtgggaggcagatagtgttgcagcacaggcgatcatctgtctgtttgcacctttcatcacaaacagtgaacttttcgccatgatgatgaagcaatctgagatcgaagttctccacgccctgacttattctgatatcgtccgtcagtgtttgccaaactctcggcaaattattgaagatattcaaaacaatcaggcagttctcgaacgttctggtgtgatcgtcaagtacatgcgtgaacttgaagttcttggagcacattatcgtctcgatcctgagtctgtagacaaagaacaggttcgacgttgtatcctacgtgcattgttcgcgctgatcggtctggaagggattgaatttatctccagcttcgcgtgtacctttgccttggcagaacagggtgtgtttgttcaggtcggtcagcttgtccagaaaatcatgctggatgaaatgctgcacaccaagatggatttcgaggttattgatatccttctgaaagacccggtgtggaaggctagttttaatgccattaagcacgagatcaaggaaatccttgacgaagttcgaacaaaagagtatggttggggtgattacctgttcagtgatggtcgtgcaatcatcggattgaatgcgccgctcctgaaagactggactgactggaactgtgctccgatttatgactactacggtattccaaaagatttcgaagctcctaagcgcgatcctctgccgtttatggatatctggatgaatccaagccgtcagcagaacgcaaaccaggagcagacaaacacggattatcgtttaaatgcggcagtcaacgatacagacggtgaagtctgggacttttaaggagtaacattggacaattcgatttttgatttcggggttgcttacgaccccaccaagattcatgtcactttcgatggtgagcgtattatgggcctggattgtgatgtcaaggtttcatgctctcgccgtctgaatggtgtggcctgtgctaaggtctttattcaaggtcaaagcccttgggttgtccgactgaaaaagcttctgggtgagcaagggcgattgcaacttgagtacaccggaagtggaccattccacgacagttgtaactttgtggctgatatggttgtgaaaggttatgacgttgattatactggcaacatcccagtttttgtttttaccttcgaaacggagaaataatgagtatcaaagacaacattttcattatctacggcaaggacaattgccaacactgcgtccgggcaaaagagttcgctaaatccaaaggtctggagtttatgtatctgaccttggaaaaaaactacaccaaagaggaactggtggcaaaatgctctccagtgatcccgacaaccgtaccccgtatctttatggatgatgaaaccagcacccggtacatcggaacagccgatgagttcattgcatacgtcaatgcaaacatctgagggggtagatgagtgaaagtagtaaaacgcgatgggcgtgttgaagacttctctctggaaaaagttaaacgagcggttgaggccgctctgttagcaacaggtatggacccagaagcagcacatcacactgcggtccgtatcggtcagaggactttcaagctattcatgacgacacctgtgagacatgttgaagatttccatcgtgaagtggaaaatctgttgatggaagaacctctactccgtgacgctgctcgcgcctatattgagtatcgccatgatcgtgacaacgcgcgtgaaggaaagggaaaactttatgcagatatcaccggattcttggaccaatccgcagaagagttcacccgtgagaatgcaaacaaaccaagcacggtcgtaaacacgcacagggacctcttagcggggattttgagtaaacatgtggcattgacccagatactgcctaaaaacctcgcagaatggcatacagagggttttggacatattcacgaccttgattacctggtaagccctctgacaaactgttgcttggtaaattaccgggacatgcttgaaaatggtttcaagatcggcaatgctaagattgagaagccgaaatcaattggtgtggcaaccactgtattgacacaaatcatccaggctgtagcgtcaagccagtatggtggacagacttgtgctcacatcgacgaaggtctgaagcaatacgttgaaatgagcttcatgaagaatgtgaagcagttccagagccacaggaacgccgttggtccgaccaacaaaatggtttatgatgcaatgcagacactgctttatcaggtcaataccctgatgagcgtaaatggtcagtctccgttcattacgatcagccttggtttggatacatcaatgttcggtaggatgatcacttataattatctaaaggtccacaaagagggcctcggcgctgataaggtgaccccagtgttcccgaaagttgtgttcttcctgaaggaaggtgtaaacatgaatcctggcgatccgaattatgatctgaagttgctggctatggagtgttgtgctgagagaatttaccccgacttcatctcagtaccgttgaacatgcaagtgaccggatcttcggacggcaaggtgacgagcatgggttgtcgaagctttttatctcactttgcaaccgaaaatggagaaaagtacgatggacgtttcaatcttggcgtggtatcattaaacttacccatgattgcagccgaagcaaaagccggaaaaggtttcttcacagaactgcttgataagcatatggaaatggcttatgaggcacacatgcttcgtgttggtcgtctgatggatgttacggcatcccagaacccgacattgttcatggaaggtgctctggcaaggctcgggcctgatgagaagatcagtaaactcttctatgacgggtacgcctccattagtatcgggtttgtcggcctttatgaggctgtggaaatcctttatgatgagccagtacgcaaggagatggcgatgaatatcctgaagtacatgaaggatatctgtgcagagttcaaggagcgcagtgggttaggtttcagcctgtatggaacacctgcggaaagcctgtgttatcgctttgcaagcaagttacaggagaaacatcctggtttgattgaaagagattacctgacaaactctttccaccaacctgtgtggctcaacagcgacccattcagtaagtgggattacgaatcaggtttcgcagagatcagtaacggcggtaatatcggatacgtggaaaccccgaacctgaagcataatatgcaggctcttgaagcgcttattaactatgggtacgagaacattcattatttcggtatcaatcagccagtggatcagtgctttaaatgcggattcagcggtgagttcaaggcgactgcaaaaggattcgaatgtccttcttgcgggaaccatgaagaaggaacgatttctgtgattcgtcgagtttccggatatctgtcagcaccaaactcacgaccctacaacaagggtaagatggaagaggtgctgcaaagggtgaaacacgtatgaatttctgtggttatgaaccaacagacctcgtgaacggagagggggtcaggtgctccctttgggttagcggttgcagtcacggatgtcgtggctgctttaaccaaaaagcttggtcgtataactacggtcagcctttcaccaatgcggatgttctcaggatcatcaaagatatgggaaggccatttatcaagggcttgtcgatactcggaggtgaaccacttgacccgcaaaatgttgatgaggtcgtaaaagttatcctgcgtgtccgtgcagtattcggagatagcagggatatcatggtgtggactggatacaccttcgaagaagtccctgaaagggttaaaaaacttgttgacattataatggacggcaagtatgatgagtgcaatcctacaaccaaaaggttcagaggttctgacaaccagaggatgtgggtaaaaataaacggtgtatggatagaggagaagtagatgagtaagaagacactgcgtaaggcataccagaaagaactggcactggaactccgtggcaaaaagcgtaagaacaagcgcaccactgaagacgaactgatgcaactggtagctgacgctgctgcccgtggcaactactgaggtactccatgactgacgttatcaacgaagaacagacctttgtgccacaatcgcaactggaaacgctgctgctcggagattcggaggaactggcccgtgagtttgtgggccttgttttcccaagactgatcaatcagtttacggaacaaactcagtatcaaattgaagccctaaagcaaatgaaggctgacgcacgtaaaggccaggatgctgcgatggagaaagagcttaatgctgctcaggttaagctgaagaaagctctttctgaagaggttatgcagaaggtgatggatacgatggttgaccttctgaaagaagcgctgacaccgcacgagcttgcttacgcgatctaccaagaacgtatcaccatcaagatttctgggattgccgcccgacttgaaacggcttttgaagaggcgctcggagagggctaatccgaaaggaggtcttcaatgaatgctgcaattgcggagattcagcgtatgctgatcgaaggtgggtttagcgtcggcaagtctggtgctgatggattgtacggacccgctacaaaagccgcactgcaaaagtgcattgcacaggctaccagtggaaacaataaaggaggtactttgaaactcacccaagcacaactggacaaaatcttccccgttggtgcaagttctgggaggaatgcaaaattcctgaagccgctcaatgacctgtttgaaaagacagagattaatacggtaaatcgggttgcaggattcctgtctcagattggtgtggagtcggcggagttccggtatgtacgtgaactcggtaacgatgcctactttgacaagtacgacactggtcctattgcagaaagacttggaaacacaccccagaaagatggggatggtgccaagtacaaggggagaggtctgattcaggtgaccggactcgcaaactacaaggcttgcggtaaagcactcggtcttgacctcgttaaccaccctgagttgcttgaacagcctgagtatgcagttgccagcgctggttggtattgggacacgagaaacatcaacgccgcttgcgatgctgatgatatcgtgaaaattaccaagctggtaaacggtggtacaaatcaccttgccgagcgcacagcctattacaaaaaggcaaaatctgttctaacctcgtaaggagaaccaatatgggaagaagcaaagaggctcgtgcattaaaactttcggctcgtcagcaacaacgtgcagaaagacaagcaaagcaccacccgaaattcgatgaggaacgtaacagcgccccggctctggttgctctgaatgaaaagcagcaggattaccttcacaaattgcaaacttgcaatatcatcattgcgaaaggtatcttcgggacaggtaaaacctacctggcatccgcccacgctgccgacttgctacgtagaaacgaactcgacaagatcattgtcgctcgtccatacgtgcagacgggtaaaacctccggcttcaaaccgggtacttcactggaaaagctgttcccctatgttcgtaacatgttggataccatccgcaagcgcatgggcgacggggcatattacaatgctctgaaagacggtttaaatgggcgtatcgaagttcaggaattggaaagcatccgtggtcgttcattcgacgaaaagagcttcctgctgatcgacgaagcccagcagagtaccccagaagaaatgctgagtatcattactcgtatttccgataactgtacactcgttgtgatgggtgatgccagtcagaaagacatttatggtcagtctggcctggagtggctgattgagtttacccagcgacacaaccttgcaggtgtgggtactgtgtcctttgatgacccgaatgaggatatcgttcgtggtggtatggttcgcgacatcgctcttggcctgatggctgaccgtgacgcaaaactgtacacgccgatggcttcttaacaggaggaatatggcatattatactggggtaggatcacgcgaaacacccccagaggttatcagcgtcatggaagacgctgctttccgtctcgccaggctcggattcactcttcgaagtgggaaagctggaggagcggatgctgcatttcagagagggatgcaaaaatatgacgaaactcttgacaatggaaagaagaaagagtatcgtacacgcttggcagagatttacatcccttgggacggctttgcttcagacaatgaagacctttgggacttctgggattatcccttgagttaccttgatcatctcatgcctgaacaaaagcataaaagggatcagttggttgaggaaatccatccgaattatgaggctctgaaaaggaaaagaggtgcttttgcactccattcccgtaatgtgcatcaagttctgggagcaaacatccttgatccaaagccctctgccttctgcctttactatgcttcggaagataagcatggcaacccaaaaggcggaactgcaacggctgtcaatctcgccaaaaagtatggcgtgaggacgcttaacctaaacactccggagcgcttggccttgcttgagcagttcctgaccagtcttgagaggaaacgaggtgtccaggtttagagagaagctgaatcagtcctactgccttgtgaaggttgaaagaaagggctgggttctggctaaaaagacgggaaaacggatttatgttaccgaagcaggtggggagattcgttatgtttgcaccacagatgacacgaatcagttcaaacatctgactgaatctctagagtacgagtccaagaaaactcttgtggtcggagatacagtaaagctggacaatttcgggctgttttacattgtggatgcaggataccgtggagatgacggtgaagttaagtacctgatagctcgataggaggagtatgacagttagtattcatggggttgtttcccatcgaaaacttatggaactgaagaattgtggtgttgtcgagcctgaatttttcgaggaagaagtaacgaagcttttcaccttttaccgtaaggtaatagcacagagtttgtacgagatgaatgatgggtttcttactcgtattatctacagcgaaaaggtggctgaacgtgatgctcgttggatgtttccggacagacgtgatctacttaatcatctgatttatctggatcatcagggtcgtgaatcgagttatgtgaatatcagtccgaaggaactgaatgagttcacattgctgcacacagcagcgttagcctctgagagggcaagaaaagttctcgtgacattcaagtacagcgatcaagtgcttgtggatgacgagacagggtactacattgactggctgatgaagaatgcttacattctgaaaggctacattgcaaacgctcgcgaggaggattaacatggaacagaacaaaaactttttcggtatgctgccggggatgagtgggaacatttatagctacccggtccactctcacgatcacgtcatctacattgatgatctgtcatggctggaagaccatcaggatcgtctgcaagttatccgccaggcaagccctgatgacacgatccgggtggtgattaacagtcctggtggggtagtttctatcgctatggcgtatgtcagtgcgatccgtgagagtcaggcacagatcgtcacccatgccgaaggcaacgtttgttctgccgggacagttttgtggctggcctgtaaggatcgcacagtgtcaccactgacagagttcatgttccataattatcagggcgggactttcggtgatggtgcaaacatgtacgctcagattgcattcgagaagcattattttgatcgtctgatcgacaccttctacaccggggttctgaccgatactgagattgcaaccatcaaaggtggtggtcaggtgtggatggatgagatcgagatcgttaagcgtaccactgcggtgctgttggatgagaaaaacatcaaacgtatgcagcaaggtcagaacccaatcatttccggggagaagaaggctaaagaggagaaaaaggtcgttgagaatgttgacctgaacaacctgccagaaggtgagcctgagagcgtgtttctgaagattgatgttgacggggaaatgttcaagttcgatgtatccacgctgagtgcaaaagattttgatgccttcaatgtggaagaactgcaatccatcctgtctcagatcggtgcgctggcagcaggctctgaagaacctctgaaggttaccactcgaaatcgccaggaactgattggtgaaatcctcaaagcctctgaggaaatcgttgcaagtattctggagcaaatggggagctaatgtctgcacctttaaaaaagaaggaagagcgcagggcatacgatgtctacgaaaccccgacttgggctgttgaggcccttttaaaggttatcccgattgattacaccaaaacttacttggagccttgcagaggctccggtaggatctacaacttcctgcctttgggaagcgcgtggggtgaaatccgtcagggcgtagattatcttaacaccgagtacaaccacgtagatatggttgtgaccaacccaccatactctttggcgcaagagttcgtcaccaaggcacttggagaggcggatgttgtgatcatgttgttgaggataggattccttgagagcatgaagcgttgggagtggtggcaggagaacccaatcagttctcttttggttctttctcaaaggccatcatttacagacgatggaaaaaccgatggcagtggttatgcctggtttgtttgggacaagaaaaacaagctcggcctgaagccattttatttcctggagggacagagtgacgaatgtcgcaaacaagatgcgagagatcgcaaacaacggagaaaagcaaaccccggagtcactgaaggaactgtacgatcagatagtggacgggatagcgcagtgtgcgaggaaggggatgtacgggatgggactttctctccagttcccggaggagatgaatgattatctgccccatattgttggcgatcttcgtggtggcggtttcacagtcgatatcatcagctaccaaccaacaaaacaaggcactgcaataaactttttcgtaacatggtaaataaacccgcttcggcgggttttttcgtttttgtacttgacatggagaaaataaacacttaagctgttttccaacagaggagaacaacatgcgattttacatttactaccgtcctttagagaccatccgcttcggagaatacatgggtgaccttatccatatctcgacagaggagaaggattactgccctgacgggaagatttggaaagttcaacgttgcaatcgccctgagagtgtgtatactcgattaatcaagatgttgaaacacggcgggatggaggacgatatggtttatccactcgacggaaatagatcactaaaagatctggtcaaatacatgaaccaatgggagaacaacaaatgaaacaaagtcttaccaaagaacaggccctgatcatcaccgggttcacaggaatcctttgctgtccgttcaacctgtttcacgaagatgtcgaaaagcgcctgggccgatccgtatggacgcacgagttcggcagtaaagagttctccgcagaactgaaggatgtttatcgtgaagacttcatggcgacgatttacaaaggggaatgatgatgaccgaactcaatgcccgtgaaaagcttttggcgatagctgattggctgggatggcaaaacgaaaacctttcatttggcttgaaatccccagaggacgctgttaagctgtacaactactggcaggaacatgcagacagtctcccggaaatggcagacgacgagcaggacgatgagggacgctggttgtttatgttccgtaaggcagcactgggttatgacccgatgggccacgacgcttctattttggaagcccttggggaagaaaagtacgacgctgaaaataaagacaccgacatcggcttttacgacatccgacaaacagtgcgtaaaatgtacatcaccgatgcagaatggaagttacaaaagcagtacggccttgtctaaactgaaacaaaacaggagaaaataaatgattaataaaacatacaccgttgttaaagacctgtgcaatgagaacatggggacaccctccacagtgggtcaggtggtaaccacaattgtggaagttcctgctgataccgctgtagttgtgttcgaccaagaaggccagttttgtttcacctctacagtccgtagcgatgtatttcttaccaaaggtggaaaatccagaagcagagatgggtttggtggtggaatcctaaaccgaatttttgctttccgtatcaacggtgtttggtatgaaggcaacgatgtgtacaccgcagaagaactggggatcaccgaatgaatctctatgcaaaattgactgacccccagaatggttggaatgacgacatggaaaaggcccgtgaatttttaaaaactcacgatcaggaagaaattcttcttgttactgaagttgctattgacaggtcgagcaccgaagtggtattgtctaatcacgggcatggttggaacagtgtgcaatttaccttcttcattgagggtgagactggtcttgaagagtatgacatcttcagcaacaagaaatcattaagacaaatttataaaacatatattcacgaagatttctaaggagaaaagatgaaggtatatttggtaggtggcgcagtacgtgacggtttgctgggccgtgaagtccacgaccgtgactacgtggttgtgggtgcaacacacgaacaaatgattgaaaaagggttcacccaggttggcgcttccttcccggtatacctccatccggagaccaaggaagaatacgcgctcgctcgaactgaacgtaaggttggaagcggtcacaaaggttttgagacctttttcagccctgatgtaacactggcagaagacctgtctcgtcgggatctgactattaatgcgatggctcaggatctggataccggagaaatcattgacccgttcggtggtcaatatgatatcgaaaagaaggtcctgcgacacacaacgttggcgtttcttgatgatcctctgcgtattctgagagcttacagattcaaagcgcagttgggtaaggaatgggatctccatccggagaccaaatctctttgttaccagaaccgtcacgaacttgaaagtatcagtggcgagcgtaagtggaaagagatggaaaaggctcttgggtctgataacttccgttcctatgctgaagcaatggcagaactgggcgagttgccagaactggaatcgctgcgtggtgtagagcaacctccggaacaccatccggaaggtgacgcattcatacacacattgctgtgcctagatatcgcagaccagtacgaggcaaacccatacacgaagtttgcagtcctgtgtcacgactttggcaaggccgtgacattctccaagtatgggaacctgctcggtcatgaagaggcagggcttgctccggttgatgcactgtgtgaacgtattcgtgtgccaaacgatttccgtgacgttgctcgctacgtgactgagcaccatacgcgtgttcattgcatcgcccctcgtggtggaaacaagggtgcaaaaccgcgatcactaatgaagcttttcgaagctgctggtaacgtaaagagcatcaagacagctatgaaggtcagcgccctggctgacgcatgtttctgtgatgcaaaaggccgtggcccgacaaaggcagcagaaccttacccacagggctacgttctgatggatgctttccggtgcatggtggcggtagataccaaagtaatctccgctgaaggtttgagcaagggcaaaacagggattgagatcggggaaatgattagggtggcacgtatcgacgcaatccgcagcgtcacacagcgtcaaattgcctggtaaggagttctgtatgaagaaatcggataaggaagagtacacatacgagaaacatcacttttacgctgacaaacacgcagggaagcaggtttgtgcatggtgcggcctcgtggccttaaggaacaaggcaagcgactggtgcgtggataagggatgcaattacgcattgcatccatcgtacagaagcgccatgtttaagttcacacaatttttcaaataggggaaaaataatgcctattgagcttgtaatttatttgtgcattggtatactggctatgttgacgattctggcgttggattggttttgtatggataagataagttcatcatccgtcggcatcgggctgctgatgatcgtcttttggcctctcggacttttctgtttggtgggtggcaccattgccgccatttttgaagaagattttgttattgcaaggagaaagaaatgaagacacgtatgtactgcgtggtaaatcaatacattgctggcattcacgcaggtatccagtcagcacacgcgatgtctgagatgttcttggattactctcaacgccggaacaatgccggaaacctgttgtgggattgggctgaccgcgataagaccgtgatcgtcctcaatggtggataccagtcgtcattgcaagaactgtgtgagaagttgaaacctctgagcagcacttatccgtgggcctctttctgtgaagaacaggatgcactgaacggcgctatgacagcagtagctgtggtattgccacagtacatgtatgacccgcagtattccgatgtggtcaatctgtaccaacccggtaagtacatcgcccctgtggtagccaaccagtaccgcgatgaaatgggaaatgtggtgcataactacacacaacctgaaaaagacctgatcacaatgatcaaatcattccgactgaaaggagaataagatgaaagtaagtgaacttgaccgcagtgtgattatcgagatgatccgttcagctacgctgatcgctactactgagatccgaactatcgggtcagattacaaaaagaatacgaatttctttgacctcgccctgcgggatgtggtaaaaggtgttgaacaacaactgttaaaggacgccgaataatgatctacacaatttataccctattcaccctgcttggtgtggtattgctgacccgtcactggatgagcggggaagatttcaagatggaggcaagaagtttctccatgttcgtctgccttgccgttatcgagggcttgatgatggtaacaaccctgatcccaccttctgctgggctgttcgcaggaatcctgtttgggatttggatgtggagacatattttgtctgcccgtgcaatcttgcaggagaaagtaatcaagaacgaaaagatgctggtatccatcggcctgaatgttcttttctttgtgcttgtatcggtgagctacttgagctaaggtggataaatgaaagacgttcgtggagaggacttgaagattggtgacgaggtttatatctactggggaggcaatgaattgcgccctggtaaggtaaaccaaatcaagggaaataaggcgaaaatccttgttgattcttggcctaatcacccagatccagcacaccgttattccatgtcgaaatggaagtcgggcgagtgcatgatcaaggcagaagagccaacaggctggtatccggacgaggtagttttattgattcaggagatcattcgtttgagagacgaggcgaaattcttggaggagaagatcaagtaccaagatctcttgaatttctgggataaaaaccgaccatccaatcttgtttgctcttaaggagaaatatgaaaactgtagacttgatgcgttgctactctggcagcatcgcttatgggactaacctcccaacatcggataccgatatccgagggcttttctgtgcagaaccgaagttcatccgcacaccattcttcaatatcaaggagcaaacccttgctgacgaagaagatgggaagatttatgaactgacaaacttcatgaagcttttcgtggagatgaaccccaacatcatcgagcttatgttcgtagatgagaaggatattctgcaaagctctgatgcgtatgactatctacgtacaatggcaccagaactgctatcgagcaaggtggcctttagcttctcaggctatgcaatggcacagcttaagcgtattcgtggtcacgataagtggatcagcaatccacaacctgaagcaaagccaacccagaaggagtttttccgcttggtgcataactacagcgagcacccgttactgaaacatgaggatttcatgcaggcactggacggcctgaacagcttctgcatcctcgtaccttacggtaacaacgtttacggtgtgatggagaactttaatagttctggcctattcaatgctgacggatcgattcgtaatgtcgattaccagcaactgaccgatgcggataaaaagcgtaagcctttgtttatcgtaaaatatctggcagaagagcacaagctggcgaaagagaagcaccggaactactggacgtggaaggaaaatcgcaatgaggctcgtcatgaactcgaagtccagttcggatacgataccaaacatgcgatgcacctcgtgcgcctgatgcgtatggcggaagagattcttactgacggtaaagttctggttaagcggcctgacgctcaggaactgcttgatatccgtggtggcaagtggacccttgaagagcttcttgcttgggctgacgagaaagatcgttatatccgagaagacctgtacaaaaagacagatctcccaaaaacaaccgatcttgaactcgccgctcgtgtacttatgaccgctcaagatatctgctgggccaagatcgatgcttgaagcagtaatcggtatacttggggttgcatatgctgttattgctgtggtatactccataaagatggagaacgataaggttctccgtcagatttacaaggccaagacagaccatgattggtctgagatttgcttcgcggtcgggttcgcctggccgcttggggcattggtccattatgttatgaggagaagaaatgagacagcttgaatttatgggaagaatggtcgagttggttgcggaatggcaaagtgaatacaaaatgcaccgtaacatctctgatgaaccagaaaactggcccgatattcgagaccaggaggactggcttggtgatttttttgtgtggttacagtgtaaggggtacacattatgagttatggtttgttgacgccagagcaggcggagatcttacgtaagcgtttcctcttgcaagaagcaacaggcaacgacctcaaggatattgcaaagaatgttggtgttggttgtatgcacgatgcctgcccgaattgcggtgggacaggtattcgtaaagatggcctgggtatgtgtgttcacggcatctcctgcccctgcccgaagtgttctttcacatgttgataggcggtaattgcaatcacttaggattttgaacctttgtgtgattgatccttcctcctatataaaatttgccacaaccatgataaaatggaggttaatattatgataggaggtagtatgtttcagaaattggttcgtgaacaccctaccctacaagaacactggcaaactctgctggaaaagagttttaatcatcagggatgttaaaaatagcatcctttacaccattcgtgtagggcgattggaggtaactcgtggtgttgacactcaaaacccaatgacatacacgttccgtgttggagatatgggtaagctcgatcctgatgacttggaagaggctttcgaccagtacgagggttttgagacggcgatccgggacatgtatagaacaatcgacatcatcatcaatgagcacaagaagtctctgggatggggatacagaatcaaagactggttcaggaaccctccaaacaaggttttctttgccgttttcattatctacgcaataattagcgtggttgtgtatttttatccattattttgaggagattgcatgagggacagaggagattattacaaacagtatgccgcccggaggcgtgagatagaccgtcagcgtcgatccacaccagaaggaaaagcaagacaattgcaaatccgccttgacagaattgaggcggagaaacgtgcaacactcaatagtgagtgggacatcttcgttcgtgaagaggccaaccttctttgcaacgagaggatgcgtgacacaggcattccttgggagtctgaccacatgctgcccctccgtgcaaagattgtatctggcctaaactgtggtgataatatccaagttatccccgcaaaattgaaccgtagtaagaagaacaacatgatctacaccaaccgactggagtggattaaggatttggagaccctatgcaggacgaattaataaagctttttgtaaaggatacaaatcacagcgtgatcagtaaactgccgggaatatccggagcagtggcaaaagtcaaatccggatcagaatggtcaatcgttttcgttgtgaaggctaaacacaatgcctattctgatggagtgctttatccaaagcttacaataaagaagagcgcaggaaaaaacgagcaaatctttttgataacaacgaacaaggatgagaaaatctggatttatcctgatcgtgtgtgcatcggtgagggcgaggtatacaaccgagatatgtttttagactcatcatccccaacagatgaagaagcccaaatgctaagaatgagcaagggtgcggatcttgatatccttatgaagaaattcggaagagtacccggaaggatcttggaaagggtgatgtctggaatgtttgttgaggagtatgtctctgaaagcaaagaaagagtgattgttttaataagttaacccgccattggcgggttttcttttatcagtcctttgtcatcctttcaatgaccagactgtccgaatcatcaagaactgtcaggtgctcaataggaatgtccatcgttgttggcatcccccggacatgacattcgaaccaaatatcgtccaccgggtaaggtattcggtttggaccaatcttggatcgttcaagaacataacacaccctgccgtttagctggaatgtgagcgggttcttggggctgaatccgtataaaaggcagattgtatccgggcgcacacgttggtctggctcattacggtccgggcgaccgcccttatcttctaacatcagcatggtgtctccttattgggttgtttaagacatcatatttgataattgtgcgttagtcaatggttgacaaaatatttatttctgccataatggggaataaattcggataggagattgatatgtgtgaaaagtatggtgatgcaagggaagaacttgggagaatgatcgaaaggaaggagattcttgaagaaatcctgagtgatatcgacctgtgtatgcaaatcaggaatggtgctgagaaaggctcccaggaaagggcaaactgctcgcttcttatcgacgcattaatacacactgcacagaagatccagaaaagaggtcttcaatgacgtacagtatctacggcagaatgtctatggacccatgctcccgcgagggagagtggtactgcctgaaaagtaaagtaccgtttgacaagacggtagaagtaatgcaacattacagaaaaacttggcgatatgttcagaggagacttgaatgtttggatggtggaaaaggcgcaagcttaaactgatcggaacatccacttggacggtcaactggaccgacactggagaaagagatcgtggacaatggttgttctatgagtctgagagtggtcgcaggtacttcgaaagtacgcatgtaccgtggttactgagtaaagaaaaccgacttcccggttacgccgggtgcaaggcgtgggccagtggtgggcgacttcccgatactttcacaccagtgaaggtgattgaatgatctaccgaatcgtaaatattgtgatccatgcacttgcgttttgcgtagtgatgttcggggtatatgttgggctggacatgaagatttatccggtcatgtacgcatgtgctgcgtgtgcgttggttgcaggctggtttttgacgaagcatatcatgggagatgaaagattctcagaaatgcttttccgtttttcacacctcatctggaggacataatgcaaagcatacgctacgaggagcttctacgagagatccgcaaagattcaattgatcagtggttccattctgaagaggaataccaacaacacaaggagaaagagatgggcggcgatacaattcttgatttcatcaagcgggaagtgtggcaggatagcgatacagggaagtggcgcttcaagaacaaggagttcaaacgagaggggcaagcagaaaaggccgctgtgcaatatttcaagaagaaaaactcttgattttatggtaaaatagagttttacacaaggagaagacaatatgtttgaaatgctcttgggcggtaaagcccccatctccgccggaagcatcagaaaggcaatggctgggggtgcagacctgcttgccttgtctgaaagcggaaaactttacggtatctgtagcacctacctaagcggtacgggtgtagcaactacaaactggacacagatcttagatgatgttgaggatttttggtcaggattcaggcaatgccttgcaaaaatgaaagatgggagatggttattttgggggccaaactccgtgggagcgatccttattgtacgggctggaatgcagccgtagagtttatcctgagacaggacaacaacaaagattccccccacacaaattggtaatgcgggcggtatatgctgttgttgccatcattctgcttctcactctgaaaccgacctttacctgaagtgacccaccacacaaggggagcctgaagtggctcctctattcctgcctgaagagtcccatcaattttgtctaaagaggcacatcaatttcctcttgacgtaaactgtcagccctgctactattacctaaagagtcacaggtgctgaaggtctgcacgaaacaaacaccaagggtgccttgcacctgagaattgaataattctcattcaacaatctttacggacgttggatgtcctgattgttgaactgtaccaccgctcctgcgtgaaaggttgtacatttcattaacacacaatgcccgttgcacgggtgaactcgttcattgctctgcaacacaacatgtttaaggaattgcatttcttcgacacatgtagcctgaagtgtcgatgctgtaaacatatcgcagggcgattagccacaggctaacccgtatacgggtaaacatatcaaaacccacccctcccccgcccggagggaaataaaagaggccctgtcttgtatctcttggggacgaaaaatatccgttggctctatgtctgatgtgctagacggacaatcacagcccccgaaggttgtcaaggatctttacaaaatatctgagtggtccgatgtcgagacccttgcgagtttttggcacgatgattgcatgatgattacttgtgtgactaatgattgcctaatgaaactatgatgatttgattgattagccagcttacagcacgatttgcccttgacttgcttacttttgtgtgggttggtctatttaacataatacacgttatacgcaccacagatcggactgttgcatgggtgatagttgcactatgttaccattgcatcaatgaaccattactatgacgatgattagcctgctatatgttaccactgtgacagtttacacctgttattattcattttgtggggtgttttgtagatgataatgcttttcataatcattataatttcgattttcatttcaatttctaaatgaaaatcattccgcaaataaaaatattttgtaaatttcgcataaaacacttgacagggagggaaaattgtttttagcaatactctgcttttgagcattttgccacatgataacaattctcgtttagccctgtgatggaccggatacccggcaatgctaaagcattgaaatagttacttattgtaactattttctgtattactgctacacaagggattaatagacttttcctatcaagaaaaagcttgacacttgaggcatcttttatgctcaaaaacaagcctttcagcaggccagcggcctgatttacagatcgattaatcatggtttgtcaaccattaacggcgatttattgctaataaaaagatctaggccgctcggcggtcaatgtgtaacattgatcactttgtgaccggatcaattgactttcatcacctcgcgacactataacacaaagcccttacgggttgttttcgccacggaaaacaatgtccagattgaccaaaggggttttgtgaatcccctttatctggacactataacacgagagcgatcaacgttagttgatcggtgttatcgtggcgagtgtgataatttcattgtgtaactattcattgtaaatgaataataatgtaaatgattagccgttgcttaatcacgtatgtgattatatcgtagcgtctacgagccacgataacgcgaacgaaaatgataagtattatcatttgagttactctcgtgttatagtgtcgctcgctacgctcgcgccactcaccacgatcacgcgaacgattattttatttgacaagattttatttttatgctcaaaaaagacagttcacacaatggcttagatgagaaaagttatcaaatgagagttattatcacgtattcacatgaaacgcttaaaaatgcgtgttttattcagttgataacatgcgttatcaattttggggtgttagtgggtcaaaggcgataagcaatacccttttaaacgcaatataacgagttttgagcgtgttttctcgttagccttgccgttatattcctttcctgggatctctttaaattcacttttttgcataattgccaacggggttggtgagaataattctcagttgcgatattgcaaccaacataaaagcgggtaaagatttggtgttgtgtttggggtgtttgtgtgatatgcaaaagccgggacaattcccggccttacttacaacatgatagccagtgatccggcaatgatgaacggtagatcataacggtcgaaccgtttaaatctgtgatatttcaccacacaataaaacgccaattgcaagccgtcgatcatggtgttaactgtctgggccgttgcgtcactgagtacaaggcaggcaatccagccataaaaaacacttgacaaaacagccataaagcaagccctggttttgtaaagattttggccttatcggtaacggtgcattgattgactgtaaaccgatccgccgtcgaaactttccgccttcctcaatgcgtccaccatttcgcacattttgcgaagcacataagcacaatgatcgttaaagtcaagcgcttttctaatcatctcttcttttgtctccccgaagataaagaccaggtgatcaagggtgttgtagtgattgatccacgctctcacctgctcacattccagggggcgatccgtctcgctaaaacttgacaggccgaaagattcaaacgtggttacattgtccatcaattcactgtaggcggtgtcccagccactagcccagaactctacaggatcggattgaaaatcaggatcgtccggatgaataaagcagatagaaaacagttgcagattttcacgctttgtaagggtgtatcgtgcgctatccaggccgcgccctttcatatcttccggggttatttcatatttcatgatcatttgtcctggttgtgtggttatgcgccgtaaagcccatcactattaaaatcatcgtcaaaatcggccaggtattcgaaaaattcaaattccatagctacaacatgcttgacaagctcactatttttatactcttcaggagacaggcggatcggcgcgtcactatacagatccgttagttcgatatactccccgaccttttgagcggtaacggtgtttttcttgttgtcaaaaataacttttttcatgatatgcgctcgacaataatgatcgcttgcgggatagaatccggggtaactatcagggcttttgattggcggatcttaaagcctaatttcgctttgcaaacggtggcggtcattttccgcatttccggatcgacgttttgatccttacaataccacacagatttttcacctgcaataaggttgcgtaaaaattcagtttgaccagttgcatttttaatcattttaatttacctttcagattatgccggggatgtccccggccttgttttgtttagtattcgttagcatacattgctaaacggtcatcaaaggcgctttgagcatcagcacgatcccagaataagtcttgatcttgctgctcttcaatgtctaactgattatacaccgcttgcgcttgatattccatagccaaagataaacggctatcaacttcattaataacgctttgagataaacaaaattgcatactatcctttaacatttcgagcatgtacgccgccgcgctttcgtcctggtcgtggcaatatgcagaccagatagcgggcttaacatttttcaaatgtgcataaagatttttaacgataaacggcgaaacatcgtttaagataccgatcaaagattgcagtttgtcattattgctgatagtgatgaaattttgcatttttgtttacctttccggcttgccggggaaccattccccggcctcaaaaagatattaaccgatccgcgcctggcttgcaagcttttttttattcatcctcgccgtaatcatcgccaacgttgaaaatgtccagcatatcaccagcggcgatccatagcaggtacatttccagggtgtggcgatccatattgtcgatcccgtctaccccttcacgctcgatccctgtttcggccaggtaatcgcggatcatttggtcgctgtatgcgctaaactgtaagccgtcccggaaataaggcagggcctccaccgttgacgcttcacagtccccagagtgggcgatctcttctacctgctcacggtcccgaaagatgagacaaaggcgaccgcatgaggatgaccaataaacatttttatttttcataaatctttaccttcccattatgaccgggggcgatccccggcctttaagaatactttagccgatctggttttcagagtcaaccggaaaaacatcattcacaatcgcaacaaccacggcgaacacgtccacagattgacggatcggcaagctgtcagcctgctttacgtagcctttcgcgccttcaagctgataagacacgtaatgatcttttactgcctgctgtgatgcgtgatcaatggttgtttccgtgcggatcataatgtccaggcgatccccgttcacagcgtcattaacatggcaaaaacgcattaaggttttatcatcgaaacgacgaaaatcacattttgcattatcggaaacgccagccaggaaaaagaatttatttgcaagttccatttttaaaacctcgttttagatgaaagataataacagcaggaagatcacgaaagaccacaccaggcgacacataaaacgcgcctcaatgtaaaccgggttttctgtagtgtattctactttgtaacctttcatgattcacctctaccaggtgaccgggaaccgctcccggccttgtctggtaattattgatcaacggatcgccgttgtcaaatgtttttatggcattggttccacttctggcgaaggaatacaggccggattgatataatcaggatcacggcgtaaaccactagcggcgatctcgcaagatagcggatcatcgtatgattcaataacaaaatcatcacattgcatcatcatagatgcgccataaaaacagatacccgcgaaaacttcaaacatttgattaaccttattttttcaggtaaagaatttgggttttgtcgccttttttagcgccatctttcaactcatcacaaaggccgaattgctcgcctttcagaagattatagctgttttcgtacacgttgcaagccttttcttctgtaaaagtttcctttacaatccaattacactctaatttcatggtcgtaagggaaatgtgacaagccattacaataaatccgaacatgatcaattatcctctaaaatgatatagatagcaacaacggcaagcattgcgaccaaaaaagatacctgcgccaccacacaccaagaattagtataatctaacattttgtttaccctcgtttgtggtggcaccgttgccgcctatgtagaatcatagcataagcggcgcgggtgtcaagcgttattttttgatctggtttgtgcggttgtaatcctcataacgtacacgggaaaccgtgaccgattgaggcaagaggcaacgaacacgatccgcccggttgtcatattttttgatatgctcaggggtattgtggcgggtaaacttaacacgcaaacgtaatttaagcggatcacggtcatcaatgccagtaaccacaccgaaaccgatttgcccgtaattgtggtaaaccattttacccaggaattgagattcaagcgccgcgatctgagattttacgttttgcattttatttacctttggtttgtgtggttggcaccattgccgccctacgcattaaagataacataaccacagcaggacgcaagcactattttaaattatttttgttgagaattgttctcatatgcagcgattttgcatgaatagcgacaattatgcagatagtttcactgcgttactaaatttaagggcctttgagcgtggcggggttatgtcataccctgcaaaacgctctaaaacgctttctaagcgcttccaggcttgaccctggcaagtgcatcacctcgcggagatctccttaaattcacttttctgcatagaaaaagccgggaattatcccggcctttcgtttaatcatcttgtacggcttgccactgtaaagcgcgctttctttcggctaaccgcttgttaagatttggatcgtagcggtccggcgtccaggttttggcgatgcgctccggcttgtgtagtttgtcgtttcgctggcgtcgctcgtttacttccccatatgccaggcgatcacgcttgcttgtcatcttttcaatgttgcgcatattttaaaccctcgttttattttcggttgttgtttgcatgttcaaagatccggccttgtttctcggctaattcattagctcgccattcgatgatctccgcgatctgctcctttgtgccttctttgtgatacgtgactactccgccccgctttttcacttcacacaataagccgttaccctcaagatcatttaacggaccagatcgccgggtgtggtagtggttcccgtggaatctgtattctaaataatggtacactttgccgatcctgtattcataataaacccacagcaggccccgccataacctggcggggatcttccagtagatagcagcagcagccaccaaaaacaggattttaaacacttttaataatcctctaacatctcgcggagtgtctccaggtcttcacctgtaaacactttgcggagttcctcgcccgtcttctgacaagcaagataaatctctaaacctttgcggctatcctcatcatagcccatattagcgcaaaaatcagcatgagattcagatcccagatcaatatctgacagcaggcaggaaagcacgtttgcggcgcaaggtgtcgcaacataaacacggtaaccgaaagacattgctttattgtcgttgcgcttgtaatcgtcgcgtgtccagttattttgatcaacgatggaaaccttagcatcaactttagctaattctcttgcgtcggttggggttaagccagtgtgacggcctacacggtgacccgttcccgttttaaattcagagcggtaaatcttcccgcctttttcgaaactcacgaaaaacaaatcagcttgccattctggatcgttgttaacgccaccatataccgctttaaaatcaatccctttttctttcaggaagttgaaaacggcaacatcttgatcgttgaaagtgattttgttattcatgataatttaccttttgtttggtttggcattattgccgggttatttctcttacttggtagggcttatcttaaagccccacctattaagagtcaacaattatttaatgatttctttcccgaaagaatcgaaagcggcgatcactttcaagctatcatctaacagcttaccggggatctttagattgtcgatccgttggcttgcctcttgctttacgtcctcaattgtgcggtttgcagaattaaagatcgttaaaacttgcccgttatccatgcttacgaccatttcacaccgcctttaaataattgttagttacccggtacacatggcgataagcgcgctttttagtgtggggcgcttcggtcattgattcataagccagatcataaccgattttttcaagccagtaaagcgctgcgctttgcccttcgttgtgtgattgttcccggcgacggggcgactccaggaccagcacaccgaaaccagtgtaaccattttggacggataccagatccccacggtgaagcgtggcgcggtatttgttgatcgtgtttccgttaacatcgcgaccaaaatcaaaggaatcaacaacaacgaaaaaatccccggtttggttcgtgcgtgacaatgaggccaggcggtttacagcgtcatacagattgatagatgttttaaactttgccattttctttaccttttcagtctggcgggaacctctcccgccttgattaataatgtaaccgatccgccgatggtttgcaagctatgcgatgaagttttttaaatcttttttgcgcttgtctgtttcttgggtgacgttgatttttaagccgttctcactagcccagcgatccaggtggccccattctgattttatcccggtcatagtggaaagatctttcattgcaacttgtaaagcgtgggaaccgtaaccataacgcagatcccgcgacttgtacagcgtcggccaggtgtcgatctccggggtagtgaacgaaagctcataaacaaaatatgtattaccgtacatatctgtaaagtcaagagaatgaaaatttaaaattgcggttttgttttctactgcttttttgaaaatctcgatcatgttttccatttcgtttacctgctttcttttggtctgggtattatgcgccagtctcccggcgcttgtcaaattattttttatcgggccatatgcgccgctaaacgtgcggcgatctgggatcgcttatgggttaccgggatcggcttgccgtttgcgtcgtgtacataggagacccgcgccgcctggcggttacggtaacccgctttaatttccagagtaacaaccagggccggggcgctttccattgcagcacgttgatcggcggtgtcctggatcgcttccaccataacgccggggataacctgccagcgtttaccagcaggcgcggcggtgccgttgtcgatcacttttccgccgttggcttttgcagcagtacgggcaagggcgcgagaattgaaatagtttttcatggtgtaacctcgtttgtgtggttgatttgtttcgcttgtcaatgtgtggagattataaccccacacattagccagcgtcaacaattatcttacagttattttttgacctttcacaattatataagtgtgtccggcgttactatattgatcaacgtatacccgacgatcacgcccctggaaattaactttccattgtgtagggatcttggtcccatacccggatcgggttttggttagccccttttgttgccaccacaaaggcgcgtcaatcgccgtaacttccgccaacaaagacccgtcattgtcaatcaataatgtttccattttgtttacctctcgttagtgccggggcgcgtccccggcttgttagtaagataaccgatccggacttggtgatcaagctttttctaaaatatttttcaggccgtcaaagtttgcgatgatctccgcgcctgccttttttgcagcgtccagcgcttcaccgttgatcccgttgccgttgtaaacttcttttgcttcggtcaacaaatcgctttcgtcctggtatgaataggtaaaactacaaccaataatctcattatccaggagggtgatcccgttcgcggtggcggtcacactgaaaccataatcactggcgtttaaatcgcgctccaaagcgtcctgtgcggcctcgtaagcgtggcgcgatgggttatcatcaccacgggcgatcaagtctgcgatccgctctttcaggctgtattgtaacgggatagcatatttataactattgcgatccgcgttaggattctttacagtgaccccgccctggtgatcgtcggtcaattcccactcatcgccaaatgtatcatttgtattaaagcatacaacgtcaacgctaaaatcaatgccgttttcggaataattgaaagtttcgatagtgtccatttgctttaccttttcagtgtggggcgtcggtgtgtcgccctgatgtgatacatagtaaacggcttactaactcccgtcaataccccaggacaaaaatttttaaaaaagtttttcctttatacttgttgcatcctggcggggatcgtgtactatataaggactgagacaacaacggcgggtaaagaaaatggaaaacgtaaacgtagtaacaagcgaaacaatggtgacccttttcacctgggaaacatcagcaaatcattgtcagtctagatcggtgccgttgcctcatgccttgcgtatgcttaacggcggattctaccgggcgaaagtggtagcggaaaacggggaagttttagcggataccctgtaaaaaatatttggtcctggggcttgcaatcggcgcggccctgggttatagttagttcaaagaagaggaaacgccaccccacggcgaaaaggcggggctaacgtaccgggcgcgggtgccaggtcggaaggtggatcgccggtagttcgacctgatgacatttgtaaagatttgtaaagacgcttgatccgtggagtggttatgctattatttacacatggcgaggggtaacgggaatcgcgagacaaacaccgaacctgcccgctattctgcaaatgagaatgattctcattcaacaaaaaatttctcttgacatcgcgtgtgcgtgtgtgagaaaattaccgatccctaaaaa

SEQ ID NO: 4 - DNA, 57579 bp, Artificial Sequence
  Bacteriophage San 23 Contig 1
aactttgtaagtacctaataaagcactgttaaaagaaagaaccattatctcacctgcatcttctaaccaatcttgttcagaagaataattagagcttaaccagcgtttaaaatcatctgaccagatagtccagcgttctccatcattttcaccccaagtacggtaacggagttcaccaagtttattctcaccgttcaggaaccataaagcttccccaataacttgccgtgtaaacacctgtttagatgttaagagtgggaaaccagtacgcatatcaaaacgaaattgtggtggagcgaatgcagagataacatctccagttcgtgtagtacgcagttcaccaacggataaaacatggttcaggatatttttgtaacttgaatctgcttgtgacatatcaaaagtgtccttttgcttgtggaacataaatttcaaaggttgctttaccatctactgatggttttgactgaatcttagcgaaaatttgacggtcatgcaacttatcaaagaaattctcaaaaggtagatgcacagttgcctcttcagtcacttcatgaaaaactgtatggaacactacatcagcatacggtaaagcactgacaagaatacctacaccaccaattacgaagacgtcttcttcaatattactatcaagatactttaaaaatgctccaaaagaatcttgatgagccttagcaaatataacatcatctttggtgaagtccataccataataaggcacagaatttgttaagatgaggtttgtacgttctggtaaaggtttactacccagagtcttaaaagtctcattacccatcactactaaattatctttagtgagtctcttaaactcttgcatatcctgtttatgtcgaggccacggcataccagttggagtaccaaactctccattttcaccacttgcaaagattaatttaatcattttgtaaaccctttcttaatgaaccagttgataacattcttcacagctttattgctatggtagattaagtgcggtgtgggttggtatgaaccataagcccagaatgatagctgctcaccacaatcaatacatgtcgtactctcttcagctatatgaccattaacaatcacatgaacttcaccttgcaagtctgtacacccacaatgtggacatcgaataggtgttccatcagactcatagcagtgttcaattttcatctatttaacctcaaaaactggctcaagaaccaatataaagtctacacagtcatcttcttcatccagaataccatcaaagttcttaggaatgaagtcgaagaggctcataacaaaacagtcagaagtgaccctgatagttcctcccatgttctctacagttaacactgtacgactttcttttacctccctcagaagattactcacaaagtcatctaagaaatacttcattagtgacttgaaacctttagggtaatctgtaccagagtatgtttcaatctgtggtacaagcttaacatttatactagtctttgttaagaacgttttagagaacatactatcaggtaacttacaaacagtctttccagtaccttcatgttcaatctcaacaaaaccagcttcgtcgccacatgtgactattttaaaagatgcttcattctcatgctgcgaagccataaactttttaagcatcactttaaggaaatctgcatgagcatcttgtaagtagatatcaatcatagttaatcacctattatgggaacagacacttgatgtcatcgtttttaaaaacaaaacttgtgtagttgtgaccatcaacatccagccaaacagcctgaacatctacaccatcaagattgtggtaaagctctttgatgaagtggtctttcacaatctgactgctagttgtttctagcttaatgtttgagattgctgaacctacagccatataacccatgacacgtttcttctcagtatgcttaatcttaccatctttgtaagccataatgagattggaaagaatcttcacaccataatacttctcaaggtgagtaggtacgccataaaaacctaatgcgaagttttcaaagtggataatgttttcacgtttcatattaatctgccaaccttaaattgaaattaacaccaaatttttcacacactcccaacatatactcaagggaaacattcccagtgaggtggattatgttggatacacgagcctgagagataccgcaaattttagcaacttgttcttgagaaagacctctggatttaatctctctcttaaaacgatgtgcaacgaagtctctcatttcgtctacatccattggacaaatataactctccatttcagcctctctatcagcctcccaatcatcttgtggggcataagggtcaaaaacatcattcatctttcttcttccgtttgcgtgaagtgtcaatcaatgaatctatgtttgtagccctaacttttcacgttcatcgttaagataatcatcaagaaccttttcaatctgtgaatcatcttgacagataactgtaaagactgtaaagccgtctgtatcatcaattatcttaccataaccgcttctgggatgtaactttttaagagccatatcaaatacctgtgcagcttctgttttctaagaaatactcaacaccatacatagctttttgcatcaaatcttctttaaactggatacgatggttgcgcatagcctgtacatcatatcatcatggtgcttctctttaatatttgcagattgcaggaaatactctccaagaacgcgatactgatagtcagttaccttatcagtcatctctgttaaagactcttcagagattggtttcagtagctcaccattagctagagcaagacctttaacaatctggcaagtgtcttctggaacacctgataagtccacatttggaagttctgttgcattgactggtaaattcattgccataaccattgcagcagctaataaaatctttttcataatgacctcaaagttatattaaattttgtattacattgagtataaaaataagctataacacctgacttgtcaacagattttatagcttatttggcagattttttataaggctactgccatccttccataccagactacgccatgccagaccagacttcacatcaccttaccgtgcaatacatcgcttaaaaccctcttagaagactcttaagtgatgctggtgagtacccgttggttcatgctgctcagtatactcaccaaattttctatgtcaacaactttttattcgtaatctcgaataactagcccaacagggaactgtaaagaccccttacgagtcatcttctggaactgaaccgtcaaaggtttcccgataaactcttcaggatgctcagcaagatactgtttcttctcatgagtagtcttccatgagacatctacaaagacgttaggaagagtctctacaacgaacttaccatgaccacgtttatcggtcttgacaccagtcactttaaactcttcagtgtgcatcttcttgtgcttaatcaagaagtatgaacggtgacaacactcatagaaggagtcttcagagattgaacggtacattgcaccttcaaacttagcttcaacccacttatcatgggcttcgtcaaactcttcccaagaatttacacggatagtctgtacaggaaccactctacaggtatcaccaagcccaacaatgggtgagttatcaataacttcacgacgctcaggccaagattttgaattgtcacagatatcataccagtagaatttaagaaggtgacggtctggattgtcagcattcttaatcatagatacaatatcttctaagtcccaaccatgagcataaatctctccatcaaagtcttcaacttgtggatgtaatttaagcaacaaaagtaaatctggaattagttctgctggaacgttgtaaacagtattctcacgagaataagctgtgaaaccgactgaatcagcatctcttgaaattctacaacggacaccatcaagttttggttgagcatcagcagggaacttcagatactttgcatggctaacctttgcagcatcatgagcaagctgtacacctaccttctcagtattctgtgcagactcttttgtgtaagcgtaacctttacggtctacttgtttcttgtacttagcagaaacttcaaagagagcttgctgttcagcgttacgctcattctttttaccgatgttcttaggctctgctgtgtactcttcaaacatcatcttgccattttctttaccgtaggttgtgataactttgtcacctacagcaacgcatgaccagacgttgaaggaaccatctttattttgtttgtataggattgtcatttttaacctctgagtgataccaagtattgcaagcattacatgcgtaaagctctaagtcatttttatctggtttatggaaacagtttgacccacaacgacaccggaatagcttaccatcaacacgaagaatgaatttttcaagctcaccatcttctgtaagaactgcgttcttaaatttatcttctacagtcattttctcttaccaccaatctctacgtcgataacttgaacatcaccagcaacatcaaacttatgaatgatgctttccacagtgtaagtccaaccatcaatgcgaaccagctcaccttctcgtgggacgattggattacgttgagctatggttgtagtggagtgaacaacatcataacggtagatatagtttactaggacttccatcgtgaaaacctcactcaataaccgtagtatgtgattgaccatttttgccgtagctataagatgttgttgtttgagagtttggacatctgacaacaacaatatccctacttatagcgtcaccattgagtttgtagattttgcagtcttgcatctctggagggaggctataagaggcgtctttgttttcataagatgggttacagccagccagaaaaattactccaagtgcaaccattgctttcacacaactcttaaccttattgttcacgatagtctacctctctgtatgtttttaaatagtgagtgatgagttctggtaattcactacgtttaacgtttgaacgaagaagtgtccagtcaaaacctttaccaacccttccccagagactgtacattttcttcatagcaactccagaatatcaatacgttcacctttgagtactccagtacggtctcttgcaatcttaccatcaacaataagaatgtgcgcagactttaaagagtcaccattaaaaccttttacgaacttactaggcatcactacaatggacatctcctgaatcaactctggagtatagcaattgtcgtgaagttgctgaataacgtctgcaagtgtcatttttgatgtctccaatactcaatgtcaataagttcttgtgcaatgctttttagattacctttcaagaaaaccttctcagaacctgaaagagatgaattgtcaattaacctgttcattctctcaaacaacttctgcttacggttcttgatagtttcctttgaagcacctttcatcattgctgcatgggttcttccacggtggctcataagccctcctatacaagatatagtataaggtactcttccctgagcaccttgtcaacttagttttgcaaactctccgtggagtttaatagcagcttcacagtaagctttatgggcttcttcaggtgtgtcaaacataccaagatgatagtttttaccttgtaaacgtatcattgctcgaaaccttttatttatcttctgtacaccttttggcaacccagattgggactttcttgaccgattgcaagagttttgtgaagctgtacaaacccttaaattcaagtacctattgtcccaaccgtccccattcttatggtcaacctgtaaggttttatcaggcaaatatccatccacatacaagataactaaacgatttgcttggtaactccttccatcaatcagcaactgaactgacttgtgtccatcagtatttgttctgtagtttccagccctcttacctccaaatctagagttaaaatttgcattaccttctctaaacttccaagtaaagacccctatttcggggtcgtagtccaatagctccttaagacgaatttctgtaatcatttcaacaccatcaatgtacctcataccagctcttaccaaccttacctgtgccagttacaagcgtctcactcttcaaacctaaattcttagatgcctgaccatacatccagtcagttatggctttaacttcttgagtcatactttctgggcattcccaactgttctcatcgtggtatgccagcaaaagtctagcaccaattgctggtttccgtccatttaattttgtcaacccttcttcacatgctcttctacaagcaaggttaattgcctcgttctgaatctgactttccgaacccatgagcaaataattcaataacttatgtggagatttacaccacaaccaagctccagcaacctttacaaaaccccctttagagattgcagcagtcttaccaaacacctcttcaagtgcctttttagttgctttgtagtcagcttccaagtcatctagcaacttcttaattttagggaggcgtacaaagtaagtttgcttagttaaagcaccttcttcggttgttgatgctttaatcgtcttagcaaacttctcatcacctgcaccgaacaatacatctggtcaatacactcgcaaggtgtaccagttctcttatgaacttctccgcatttctacggagtgtcggactatatcacgtagtagtaatactaccgttgcacttgggaatggtcattagcttaccaccctactctactcagttcatacattaagtatgcttttcgatagtctctgaacgtttctctgttaggaatctctatagttatgttatttgctttaggagtcctaacagagacttcgctgctgattaccatatctttacagacttaggcttccagcaattcacaacgttttacatgcgccactgacgcataaatgccattcttagctttcttacgacctttgctaatctcatgaagaagattctcatcctgagtagctcgacaagtcaagatgtcctgctcatcgttcaagctaaagtagatactgttcagtgtatgtgcatcagtccctgaatagacaacgtacaggtcattctcagagtcatagcgaaggtacttatcaatctctgggttgaggtactcatcaaagtgtttgcagtaatagcgtccatcttcttgacgaatgaactcaatctcttctttaccttgtgttaccgctttggtgaagtctttgtcacccataaagttacaaagaagaactagctgggctgagttcatatcaactgaaacaatgttagtcccttcttcacaagtccacacctcccgcataggtgctccatagacagcagcaccagatggtacgtttacaataccatattgtgtcatacgcccagttgaagtaccaaacaccattgcaccagcactaaggcgaccatcaggacgaatctggttcaaccaacctttttcatcatcctttgagttctcaatagttctgcgtctgtgcatcaaagtatagtatttagcaatcttctgtccaagctcaccttcaatcgtatcataagatgattcagtaagttttggcgaagtacggattaagcaaggctcaagcaaatctgtgtacttcttcacagaccagttatgctcaatgtactggacaccttcatgttcaacataactcaaaccacaccgctcaaccatttcctgccacttaggatgttttgtaatcatctttttattgtctttgaaacgacaaactttgacaggacgaccatctgagtctttcttgtagttccagtcatctggaatccaaccaactgatttcaagtagtctttaacaactgctacctgagtcatacgagaaacttcgaactcaattggtgtatatggtgcatcaatcaaacctgtgtagcgacttgactcaagttcaaagtggttaacgacgtggctgttatagtacttcacagttttgactgtttttactggtttccagtctttgcatttcttaccaatctttgcgttcaactcattgcaaattgcacgagcatccttcattgctacaaagccttccttgtactcttcaccagttacagtgttggttggtgtatagcaatttctcttttcaatgttaaaaatctttgtagttggcttaccaaatggcttgatttcataagtttgcatctcaccgttacgtacctgctgacgatactttgttttagggtacttggtaattctcttcagtccatctgcatgaccaaatgtttcaacatactcattccaagcttttgcaaactcttctccagtgactttacctttggtcttaatagttggaggaagatgtggttcaacctctgaagcaagctcattagtcaacttgtcaagttccttcacatggaactccataagctctttatcagctttccaaccattgatagcttgttgactcatccagaaagatgtttctttagctcgcatgtaggtttcataagtgtctatgccacacttcttaagcttgagatactcattatcaagtgcccgtttagttttggcgttaatacggatatcttctacaacacgagtgaagatttctgcattccacacaccccaatgctcaatctctggtttacgaacaccaacacgagcaccccatgcagccaaaccatgagcacctttataaccctttggagttggtctatccatccactgaacacgagactggataagagaatcctgaaagaaattactccacggcttacattttggattatcaaagttccataaatccggtgcaatgtgattgaagacccaccagtcataaccgaggccgttatggatacaaagtcgttttgcctttaacgcaaactcaacaccttcacgtaaaccacccttaatgtacttagtgtacttgtgaccgaggataggctcatctgtaaagacccatacaggtggctcttcatcgtcagatttatagtctgcaaaggccattacgtgaactttagtgaactcaaggagtaaaccatcagtttctgtatcaccaaccaaatgtaagtttttaaaatctacgttttccatttttactccctctaaaatcattaaccccatacattactgcaaaaaattataaaaagcaagttgacaatacacttgacaaggtgttaatctttgcgaagtgggtttttacttaaaaggttacttaacagtttaactatacagatactttaaaactcttaaaagattatttaatagcttttaaaaagctttaaagtataacgtatagaatacgttaagataaaagattaaaacttaatagttacttaaaagaggcttacatgcagaaaatgtttgttcacccagacatagctgactttgttagagctttgcagaagttggaagaacttgacattgctgctcaacgggaatatgctcaccatcacaggagaatggttgatatacaacatgaaatagagttgtctgaaaactatgaagatgacttaaaatgctctgtatttgagcatatgaaagatgttgctacagcgagacgtaaagctaaagacacagttgctttactagattctcttaaaaagaggttgcaaagtggtacagacctgtgtaatctagcgtcactgattaacgatgttgaaacttcttgggataggcactattatccacgttctgaaaagacacttgacttttcttcatccgaaaacttaaaatgttctagaaagaaacttaaccaactgagagagaaataatatgaatatcgatgtagaaaagatgcttgaagaaaaaggtattgacgaagcgttcttaatcaatgctgtagaaagcatggctatgattcttcgtggtaacaactacacagaacagtttatgcctgcaagctataacttgcctgaagacaagtctgataacggtgcttttgcagaacaggtcaacatgatgctttgcgacaaaacacttgctttagcatctatcgttgtaggtgttgatgcccttgcagagttcattttttatgagatgcagaaaaatgactatattgccatgaccactgaagaaaaagacttgctactactcgcaggtaatgatgaactaattgacctgttaatttcatcaactagtgctgttatggctgctcttgagaagcgaatggaagagaagttgtcacgatatgaaaaacttgattggggtgtagaagaactaaacccacgaatcaaggagattatccagcaaactaaagagtctttggaagaagctgttgaaaatgactctgtagctgatatagaaccacttcaggtgaaagttgcactgatgattccagctatctctacgatgatgaatatcgttgcactaatccagctttcacagatgatgggtgtgagtattgagttcattgaggagatgactggtggtgttagtatgcaagcaatcaatgatgttttggtgaatattggtgcttcaatcattgaagagaaactacgcattaacttcggtgatgattttgtgaagcaactctcagctatggctgaaaaagagtctgctgagcaactacactaagtctttataaatcttacaagcctccttagttgggggctttttagtaattaatgggggtaaaatgagtaatattatcgcatttactggaaaggcacgttctggaaaagacacctcatgttctattgtgaagaatatcttagaggatgagtacggctacaatgttgaagtaatggcctttgcagacaaccttaaactatctgcatcaaagatatttgacctgacttggaatgacctgtatggtgaaactaaagagactccacaggtttttgacttatcatatcctgaactgatgtcaaaagttacagaagctatggagtttaccttcagagatgaaggttaccatatggacttcaagcttatgtcagagttaaccggacgattgattatggagcttaagaaggttgctaaaccgactctattgacacgtctggggtttagcaaaaagtataaattctcatcaagacaaattcaacagatttggggtactgaagttgtccgtaaagtaatgggcgacaagttctggtctaaagaccttgaaaaaagaatggttagattctatgaaagttgctcacttagaaaccaatatggttttgtcttaatcagtgatttaagatttgactctgaagctgagtggctgagtagatttgcacaccaaactattgaagtaaaaagagacaatgtggataagatttcatcacacgtttcagaaaatgggatttctacaaaatatgagcgtgacattattcataataatggtactcttgcagaccttgagaacaagctaagagccatcattaaagtttaaaagagagaatgaagatgagagtaaaagacaattttaaagttattgaccaccgtttagtggaactctcatctctttccaatgaggtaatgattgaacgtcttaagagagttgaatcacgaaggaaagagattgcagatgaaattcatgaactggacaagattgaaaatggattgaaggcagaactacaacgaagaggtgctaatgtctaaaggtcgtaaattgaaagaggctggtcagtttattggtcattgtgcatgtccacgttgtggttcatcagatgctggttcaatctatcatcatgacgatgattcttattcgatgacttgctttagttgtaacaaaggtttcccagagtgggattttgataaaggacaaatcgtgagcacttattctactggttcagacaataaaaaccgtactttccgtggaatggatttagaagatgtcaaagaaaacctagaagcaatggacttgaaagataggaagattcctgcaaaagtccttgaacgcttaggtatcaaggttgacattgacagtgacggtgaaattgatgcacacttctatccaacttacaaacgtaatgaagatggtaagctagaacatgttggctaccgtgttcgtcaccgttacccagaagaccatccaaaagaacacctacgaggtaagctaaaagacttttcaggtggtgttggagacattaaaggtgaactggcaatgttcggttcatggattgctccagaaggtggtaaccgtctattcatctgggaaggtgagatggaatgtgcgacagcaatctatatgacttctcttgcgattaaggacaagtctcgtcgtaagaattactgtcacgtatctgttccatcaggtgcaaacattaagtctatcaaagacaactatcagtacattacatcatttgatgaaatttacttgtgctttgataacgatgaagcaggtgctaaagccactaaagaggctgctggcattctccctattgagaaggttcgtttattccagtatccagagggtgtaaaagaccttaacgaatggtggacaaagttctataaagagaaagatacagttctggaaggatttaagcagcgtatctacaatgcaccccgttactgccctgctggtatcaagaacttcgcagatggttttgaggcaatgaagaaccgtggtcagattccattgattcctttcccagaatctttcggagatttgaacaggctgacttatggcggttacggtttaggtgagattacaactctggcagcaccatcttcagtgggtaaatctgcatacactcgtgaaatgatttacactgcttggaaggataccgattacaatattggtgtaattcctgttgaagatacctatgaagagttgatggagatgctctgtgcaatccacctgagcaagcagatttctgagattccttatgacgaacgtgattgggatgaattgaagggagcgcacgcagaactatctaaaggtcgtcgtatccacatcgtagaccatcaaggggcaattgaccaagataacttactggagtttgttgactatcttgttaatagcttagactgtaagattattattcttgaccctattacgttggctctgtcacgttcagatacggatgaagaggaagttttgtctgagctattgcgtcgttgcaaacgctaccagtatgcacaagtgaacgtctgtcacgttcgtaagagtgcaggtggtcagaaggctaactctgaaggtggggatatctctgaagaggatattaaaggctctggtgcgtatttccagatttctatgaacaacattctgttaatgcgtaacaaggttgacccagaccctgttaagaaaaacttgacaaaaatcaagctaactaaatgtcgtcgtcacggtaagtcaacgggtattgctggtcatacttggtacaatccagatacaggacgcctcatcaaagcatctggttgcggagttgacattgatggtgcagcagagaatattcgccaacagtttggtattggcgaagctgaagaccattacgatgactctttgccacattatgaggatgaagtgtttgaccgtgagactggtgaagtctatactgaagagcagcgtcaaagctcaacgattccacctgtattaagtgaggatgcagatgactgcccattcgaaactgagtgatagttataaaagagaggggttcacacccttctttgaagaaaaaagtttaaataaatttcaggaagagtgtttgacaaagattgataggttctatagaatgctcctcatgaaatgcgatggagaggttgagataaaagaagattttcaccagagcatgattacagtcatcattgcgctgcctcagcataatattagttggctgtttataattaaagaagatgtgtttgaatatcaagtatatcggagaatatcatgaaacactctaaagcatttgaaaaagtttttggggattccttaaaagccactgctggaaaaccagcaaaatactatgaagagaaacgtgtaagaactggaaaaactgcacgtaaagcagcttctaaagataagcacaacttccagtaattagtatttgacaatagagtatcaacaaattagaattggtactcttcataaattgagatagaggtttaaataatgtctaaagttgttaaaatgaaagctccggtagagaagtacaacggtactgaacgtcaaactctgcgttacctgctgaaagatgtctggttttattacctgaacacttcaccacgtccgggaaaaggtaaatctattgataagaaattcccaggcaaagactgtaactacagcgtatcaattctggcagaagacggtaacaaactgtttaaagagtttactaagtctaagaaaaatccagaaggttgggacaaagttactactgaagcagttgatgcagacgacttcgaagagaagtttggttgtaagccaccttttgaagcagacacttactacatcttgaaagtaagtcgtgcagcagcttataaagatggtgctgtatggacagctaaacagtcattccctgtaatgctgattgaagaagtaaatggtaagcgtgtagctgttaagcagccgatgaagaaaatcaaagctcaagcatctgataaacatgaagatgacaagaactatgacgtaattcatccagatatcgcagttggtaacggttcttttggtagtgtgattctttctactcacttctacacttttgagaacaatgttctgacaaaacctattcaggaacagtttatcattgatactcttgtaccttacactggtggtaacggtgctaatggtgaacctgaacttgatgaagatgaactggctatgcttggtcttgatggtgttgaagataacggtgaaatcactgaagaagacgcaacagaccataaaccttcgaacgcttctgatgatggtgatgatgaagatttgccagacccagatgacgaagaagatgaagacttcgatacagaagactaatctctaaaagttactttaaagccctgtacttagtatggggctttttcatatggagagccataatggagaagtacacattaacaaaacttcccgattcagttacacatgttttattgactctgatagtattgcctataaaggtgcttgtgtagttgagaaagcaaaatataaatatgtcaataaactcacagcagaagaatctgattcgtttgataatgcaaaagatgctgcaagatggttagcagaccagagaatccttgtggaagagcttggcctgacatttgatgaagatgaatgggaaagacagacttggaaagaagctaagagtgaaaaagaagctatcatggactactcaacaggtgcttacaggaatggcttaagattgttggataaagaaagaacttgggtaggttatttaacagagaaaggtgtgcataaacataaagacattaaaggtcttgagcaccaatatcaagggaaccgtaaagatgctgtcacaccaacacacttagttgcttgtcgtgagtatcttctgtcaagaccagagttcaaattgattcttgatgggtttgaagctgactctatcgtaattgctaaagctgaaaagatgggtaaaaaggctgccttaatgagtattgataaagaccttcgccaagctgaaggcacttactgcattgatatgacctatgaaaaatcacctttaatttttattgctgataacaatgttggtgaaatatgggattgcccaataaaatcaacaccaaaagctaagaagacagttggggtaggttttaaatttctttgctatcaagccgtggctggtgataatgcggataattattttggtttaaagggtgttggcaaggttactataatgaaagcccttgagggtaaaaccacttacaaagagtgtcttgatgcaatttatgagctttatgctaagaaagagtcgtacacttatgtctcgtgggatggtcaaacaattaccagaacacccttagagttaatgcagcaacactttttcttagcttatcaggaaagaaataagaaagacgatttcacttttgataagtatgggtggacaccaaatgttaactcaacaaactcttaaagagcacctgcactatgacccgaaacaggggtctttacttggttagttgatagaaaaggtaaggccaaagctggctcagtagcaggttttaaacaccatagcggttatatctatataaaactcttcggaaaaagatatgcagcacacaggctggcattcttgtatatgaaaggatacctcccaaaatttgttgaccacaagaattgtatcagatacgacaactggttcgacaatttgagagagtgtagcaggtcagacaacaactgtaatgcagtcaaaagaagagataataagtctggtgtgaagggtgtatattaccacaagcaaagaggtagatgggctgcacaagttaagcataataaagtttgctaccatctaggtctatttgactctgttgctgaggctgaagaagttgtcaaaaagaaaagagaagaacttcatagagagtttacaaatcacggagaagctcatgaatgattaaagttaaaggttttgggagttgtccaacttatggacattggatttcactatgtggtgaagttgacccagcaaagcactttggttttgtctacctagtgtactgcaaaaagactggacagtactatttgggtaaaaaacagcttaacagtgtgaccaaaagaaaagttgctggtaagactcggaagaagatagtcactaaggaaagtgattggatgacttatgagacttcttctgagtatatcaaaaaagatattgaaagctttggaaaagaattttttgacttttacattatccaaacctactacacaaaaggtggtctagtttatggtgaagcaaaccttcaacataagttcgatgtaatgacaaaaaggattgactcgaagctcagactcttctacaatgccaatattgcagcaattaagtttattaccaaagaaacttatgaagatgctgaaaaaagaatccataaggtaatgaaagcaaattgtgcttgataactattgagagagaataaaatgtttaacaaaagtaaagctgtaagtcatgtagcaaaagttgacagcaagattgaagaacttgagcgcatccttgcaaatgctagagggtcaataattaaagaagttgaagctgttgaatctcaaatgcagcacctaatgcttaaacgtcaagagctacgtgagcatctagaatatattgaaacacgagagctaaaggttaacaaatattttaaggagtccgaatgtttaactcaagagaatcagtaaaaaactggaaccttcgttgtggaaacactcaaaagcaaccttacagtgatgagtattgggaatctttaaaatctcaatctctgtgtatgcttgaagaagcaaaagagcttgtaaaagcaattgaagagaaagaccccattgaggcactggatgctcaggcagatttacaatatgttcttgacggcttgatttacctgtcacaacatgaccataacggtgctatgaaagctgtttgtcataataataacctgaagtacacagatgattatgaagaagctttaaaacgtcttgcagacattgaaaagcgtactggtcaagagtgtattatcagaatgtcagtagttgatggtaaagagtggtatgcgattgttcgtgcagccgatgggaagattatgaagcaatcaaatctccctaaagtacagcttggtgaatacattgtagagcttgaaagccaagaactttttgtggtagtatctgagacatgcgttatctgcaaaggtattgtaggtagcttaaaggatttgggtgtagatggttttgtagaagtcaatccaattacctctaaagcagataaagatttctgtaaagagaacggactatggattgcagatattgtctactatgatggtgagcagttccatgtaacctcatacccgaaactgaattatgatgctaataacctgaagtgctggttaaaaggggttggttataatggattcacagaacattaataaagagggtgtggctcagaagagccacttctcaaactacaatatttctatgacggtgtttatgaatgacccgttactagaaaaatatagtgagactccagatacacttctggacaatgaacaagttttaaaagcagtcctgtacaaatacgggattgatattgagaaagagtattcttttgaaatctgccaacacaggaatactttcggtaaagttgtgatggctccactctttatgggtgtagaaaggactgactatggttggttgtatctaaaaagaaacttggagaaataccgtgtctaaagcaaaaaagctatcttatgatgacattatctcaggtgctaaattaggtgttgatagtatcggacaagatgttaagcacggggacacagttatgtactgtgatgaccgaagaggcagaagtgcaatcttgtttggaagaattgtttgcaagatgcgaggtaattacgttgttgcagacatggatgtgaacgttacacaaaaacttgaaacaattatggatgataatacatcatcatggttctccctgaattgtatgcacacttcttcagtcacaagagtaagtgataagttttacgatatgtggcagaatgagcaaattttcaagatttaaactagggagcctcttcggaggctcttttcatctgtaggattcgaaaatgattaagacaattaaaaaatcaaacggtacagtagtaagctttgacccagaaagactgaataagtgggcatcatgggcagataagcgtggaattatctggtcagaagtcactatggaagccatgaaacgtgtctatgagggttgcactacaaaagagatgcaccaagccatgattgatgtttgtgttgataaacaaactcaagagtactcagatatggctggacggctgcttttgggtattatctacaaagaagcctttggaggctttactaaggttcctacgctggttaccttcgttaaaaatatggagagagcaggactttgggagaagatggattattcacaggaagagcttgaatacctgcaaggttacatcgtacactcaaaagatatctcttacggttatgcagtcttgaaacagttcagagacaagtatggtatccgtgatattaaaacgggaagactttttgagtcaccacatttatgtttatgggtatggctatgaaagcctttgagaagcaaccaaagcaccgtagactgcaagatgttatcaagctgtacacttacctatctgacctgaagattaacgctcctacgccttatttaaatggtttaagagcaactaaatcaggttatgcgtcatgctgtttgattaaggcaaatgatactgctgagtctctcggtattgctgcaaaggttgcttatgatatgaccacaaagcaagctggtattggtatgctgatggagacacgcactattggtgatggtatccgtcaaaatacgattgaacacatgggtaagctaccttattacaagcttgtacgttcatctgtagaggcaaacaaacagaagagtcgtggtggttcagctaataacttctacactgctctagacccgcagattgaagatttactgcgtttgaagcaccctacaacggttccttctaaacgtattaatgagatggactactcattcggcacaaacgattatttctggcagtgtgttcagtatgatacagattggttgctattctcttacaaagatgcaccaaaactctatgacatgttctacacagcatctgctgatgagtttgctatggcagttggtcacgcagtacattcaggagttaagcacagacgagtaaaggctcgtgaaattgctaagctgtttattcaacagcgttatgctacaggtcgtgtgtatccattcttcacaaataatgcgaacacacatacaccatttaaagaaccattgaagatgtcaaatctttgtatggaaattgtgttgccagtgtatggttttgagaaagagacagacctttacagagacgatgctgtgaaagaggatggtgaggtggctctttgcttcctagctagtttggttgcagggagaatttcagaagatgaatacgctgacgttgcttattatgctcttgcaatggttgactccgttattgaccttatggattatccgtatccgtcgatgcgtaaccatgttcagaagcgtcgttctgttgggattggccttacaaatgtggctcattaccttgcgaagaactacgtgaactactcttcacgagcaggtaaaacaaaacttcatgaactggcagagatgcactcttactatctgcatgaagcctctctgagacttgctaaagaacgtggcgtgccagagtacatgaagttcactaagtatcctgaaggctgggttcctccaaagacagctaacaagaagattgatgaaaagcatgatgcaaaactaagatatgattgggatgacttagcacaacgtatcaaagaaaatggtggaatccgaaactctgtattagaagcttacatgcctaatgagagttcttcactagcaactaatacgacaaatggcttgtacccaattcgtgactttattttaactaaaaagtctgcaactggtaacgtactgtttattgttccagattatgaagagttgaagtatgtctatgaaattgcttgggatattgacacctttgatatgattgattgttatgcaattgttcaaaagttcactggtcaagctatctcttcagacttctatgttgactatgcaaagtctaagaaggtatcattggctcaagctctgaagtacatgatttatgccaactcggtaggtatgaaaaccatgtactaccttaacagtcgcattggtgtaggtaaatctgcactgcaagatgcttattgcgagggttgtggtgtttagttttaacaactatgagggtcgtaaaagaccctctaaaaataactttggagagaccatgaaagatttaatagaaaaacatgagcgacctatatacttgctccacaagcctcggaaaacgatgtactatgtgagtagcacagacatgatgataaaacaaaatgatgactcatgggttgctggtatctcttacatctctacagcagatggtaaaatctatgcaagaccttatgagatgtttaacaaagaaaattgggaagttttagacagaaaacaagcctagaaatgataaagaaaggagaaatcacgttatgattaaccagcacccaatctttttaggtggtgagagaaaaacttttgactcacttaataaacactacccaaaaatctttgagctttataaacaacaaaaagcacaagattggtcagaagatgagttcccttttgaacaatcacgtcttgattttgagagtgtcccagcatcaatgtcaggtgtaatgcttgagattctaaagtggcaatgggaagcagatactcaagttgctaagagcttggcatttgcctttgtcaccctttatctctgatgacatttatgcaactgcaattatgaagcagtctgagattgaaaacctacatgctcttacttactcagagattgtaagacaatgtattaaaaaccctgaaacaatcttagatgagattaaccagaatgttgctgtgcaagaccgattaaaaactgtgaatcgtgttcttgaagaattactggatgaagggataaactaccgactgagttatgtccgtgattcacttctggacaaagaccctttacacttccataaagtgattctaaaaggtctgtttgcagtgactgcacttgaaggttatatcttttatggcatcctttgcatgtacctttgcacttgatgctcaagataaatttcagggtattgctcaagctgtccagaagattatgcttgacgaaatccttcacactaaaattgatattgaagttttaaaagaaactttaagagatgatgagtggcagaaagcttttcaacaaattcttccagagattaaagtaatcttagatgaagtagttgaaagtgaagagaaatggtcgtattatatcttctccgaagggcgtgctgtagttggcttaaatacaaagcttcttcatgagtgggtttactataatgctgccccactgtatgatatgtttggcattcccagagattttgtagctcctaaagaaccacctttaaagtatatgattaagaagatggaaattgataaagagcagaatgctaatcaggagcaacagaacggtgcgtacctattgaatactgttgtagatgatttgaatagtggatttttagaggttccttaatgacttatgtaatttactccaaaactggatgccctcagtgtgagactgcaaagaattttgcaaaagctcgtggtattgaccatgttgtgagaatgttagggcaggactatgagctatcagacctgatggatattgcacagatgccagttcgtcagatgccattcatcatgaaaactgatggacaaaacctaaaacctgttgggactctacagaattttatggcagaggtgaataatgcttaaacgcatttgggaaggtttggttgttgatgcaccagctattgtgattggtatgcttattgttaacctatttactgactttgaacaaggttcattgtttggagccatgttactatgggttatcttcgaaatattagagatacagttaggtatcactgaaaaactaagagaactctttgcgaagttttctaaaaagatttaaaatgaaagggtctcttcggagacctttttagcatgtaaaggggcaataatgaacaaagtacagattattaaaaagaatggctcactcgaagaacctgatatcaaaaaagttttagcagcagtcacaaagtcagctagtagggttgggtataaagaactcccaccagatgttacccaagctcttgagtcagcatttatgaggcttctggtaaaatccactaagcagaataatttgctaatttctgtaaatgatattcacagtattgttgagggtgctttggcagaagtcaatcacgagatttatgagtcttactcaacatatagaaattaccgtaaagaagttgctcaaaattgggatgaactctaccagaagaccaaagatacactcttcttaggtgacagagagaatgctaactttgacagcagtttaatttctacaaaaggttcaattattcgtggttatctgactaaagaaatctttaaacagtaccacttaacaccagaggaacttgaagccattgaaaaagggtttatctatatccatgatttaagagacctaatttttggtggtatcaactgttgcctgtttgacattggtaaagtcctgaaaggtggctttgaaatgtctggcattgaatattgtgaaccgaagtctgtactgtcagccttacaggttattggtgacgtagttctttcagcaactgcacagcaatttggtggctttactttagcagagattgataaggtacttgtgccgtatgctaagaagtctctacgctatcatgctgagaaagcaacagcttatggtattcctaaagaacattaccacaactatgtcatggagcagctacagattgaattaactcaaggttttcagtctcttgaaatgaaactaaatactgtaccttgtagccgtggtgattttgcattcacaactttgacattcgggttgcttgactcagatatgtctaatgaagataaccgactgcaatacatgattgcgagcactctcctagatgttcgtatgaatggacaaggtaagagcaagaagcctgttgtattccctaaattggtttatatttatgaccagaagagacacaatgagaatatctgtcaaggccacctgtacagtaaagctattgagtgttgctctaaagctatgtatccagatttcttaagtgtatctggacatggtgctgtagcagaggcttttgagcgttctggcaaggtaatttccccgatgggttaacaggctctatagctcatctaaaacgtgcctaaacagggaaactctacagatgtagacaatcctgtgctaaatgatgtacgatgtaagaaactatacaacataggagtcttacatgccaaactatcacgtcactgaagatggaaaagtctttagggaaaatggtgtagagcttacgcagtggaaatccaacactgggtatatgaaagtgaggttttacggtaagaataatcgtgacatgtatgtccacaggttagttgctgagaaatatgtacctaacccaaataatcttccaattgtaaaacataaggacgataacaaactaaataaccacgcatctaacttagaatggggtactcattctgagaatgctaaagaaggttatgagaacggatgctacaagttccacaagcgttcatatgccgtgaaagccacacacaaagtgacaaaggaagttattgttgctaagtcaatacgagagttatccaatatacttggacacaatcgcaagaccatctcttcaatattgaagggtgtaaaagagcataataacttcgaatatgagtttgaatacatctaaatgccgaacgactaaccgtgatgaatgtagcggtgtagggtcaagcgactcgaaatggtacgctacttagaaataagtagaagatatagtctggacttactggcgacagtaagcagcttgaataaagcggggtaagcttagcgaacttacctgaacaacaagtgtagagcatttttatcaccataccataacgaatatggtgaagagttttatgtaggtcgtgctaacattggtgctgtatctttgaacttaccaatgatttaccagtattctaaagagaatggcttagatttctggaaagagcttgataagtacctagaaatgattcgcagcttccacaagaaacgttacgaaatgattgctaatatgccagcaagttctaaccctcttgcattcacacaaggtggtctgtacaaagggaataagaaacctactgacaaggttggctgggatatcgtgaagtccttcacagcttcttttggggttactgcgcttgatgagctagatgttcttgctgaaggtaaacgacttcatgaagttggaagctgtagttttgcatatgatgttctggaatatatcaacatgaagactgaagagtttaaaaatgaagatggcttcttatatgcagtctatggcactccagcagaatcactttgtggaactcagctaaaacagttcagagatatgtttggcgttatcaaaggcgtttctgacaaggaatactttacaaacagcttccatatgaatgttgcagccgacattacaccatttgagaagcaggacttagaagaacccttcttccatatctgtagaggcggcagaatccagtatgtaagagtggctaatccagaaaacttaccagcacttaagagttgtattacaagagggatgttgaaaggtttctatcagggacttaactttgacttagcaatctgtgagcattgtggcaacagaccaaaggctgatgttgaagaatgtgaggtttgtcattcacacgatatctctgtgattaacagggtgtgcgggtacttgtcattcacaaaaattaaaggtcagtctcgaatgaatgacgctaagatggcagaaattaaggatagggtttctatgtagaatacaaatgaattacgaactaatatataatgcaattattaagaaggcacattctgaaaggggtgtgcctcttacatactacaaatgtcaaggtaagggttatgaaagacaccatatcataccagtgtgtctaggtggcgataaaattagtggagataatattgctctacttacacctagagagcattatatagctcataaattactggttaagatgtatccaaacaaccacaagttatggtttgcatggaacagactagctcatgatggcctagataggaaaatatcatccagagactatgaaaaggtaagggctttgaactcgaaagctttatctattgtgaataaaggtagggttttcactgaagaacatcgaagacgattaggagaatctcaaataggtaatacaaaatcaaaaggttgtaaaaggtctatagaaacaaggaagaggatgtcagaagccggaaaaaagccaaagaaaaagaaaacttgccatcattgtggtatgactggtggtgctggtaacatgactcgatatcattttgacaattgtaagaaaaaataaccttatgtaaaacttgacaaggcggtgtaggtcttgataggcttacatcacctttttattggtgaggtaactagatgaattacatggagattagaccatttgatacagctaatggtgaaggggttcgtgtaagcctcttcgtagctggttgtaagcatcactgtgaaggctgctttaacagggagtcttggaagtttaatgctggtaaagtatttacttatgcaaacctctacggaatcatccagctaatgggtgataatgctatcagtgggttgtcaatacttggtggagaacctctggatgatagaaatattcaggaggttaccaatatatgcaaacgtattaaaactatttatccagagaagtctatctggctctggacaggttttcagttacacgaaaaaattcacctagatgtgatgaaatatgttgacgtggtgattgatggtaagtatgattcatctaaccaacagttaaaccatatcgtggttctgataaccaaaacctctggagaaaagagtatgggtggcaaggtgattgtcagtggagagccgagtaagtctcgtcgtagagtaggttacggaaaaggtgagataatggttctttcttttaacagtgctttattaggtacttacaaagttaagaccgaactccttgatgagtggagaaagtatacaaactcacttttcggtaatgttggaatggaagccttagcagagattgagaaggctggaacatttgaagttgtcggtaaaggtaactacacaatgttctacaaaacaaatttaaacgttggtgacagtattgttggtgtcactgaagaagaacttaaaacattttgtgaaaagattgagagagatacgaaatgggactctggaacagttttaaatcaaaagtaaaagcagcactagcttcattaggtatgctcactggtgttgatgtgactcatcttatgcagaactttaagatggatgagaagctggctaatgagattatgaaaagtatctatgtaggccgtggtaaaggtggtaagaaacaagcccatcgtccgtctggtgcagcagctattaaacgagcagctaagaaagctcgtaaccgtaaacgtaataagaaggctaaataatcatgagcaaaatctataacactcgcaaattacagattttcgtactgtgccagtttatggctaaagaatataacttctactattgtggtacaggttttattagtgatgatgatggttcatatctaccatttaaagaagctgtgaagctctttaatgaagagaaaaactctaagaaagatattgaaaaggttaagctaacctacagcaagaaagataagaagattatctgcctagataactttgtaaaagttactggagaagcaaaagagtttatggatgagagtgagatttcattcacaagcatcttgaaagtagctcagtaaacagatactataagggaactgtaaaggttccctttttattttggagataaaatgtatctgtcaaacctgaaacgttcggctgcaatgtcagtcctaagactcagctttgaggaacgtcaagagttcattgactcccaccaatacgacccttctaactcgaatcacatggttctttggaatcgtgataacttccgtgaaagagcacttgtccgttattacccacactacacaatagataacctgtatgaatggtgtgttgtgaagaacactattgcaacactgaacaatctttgcaggtatacaggtaagcaagcatttacattaggccaccacaaacctgttacaaagggtggtgagcatcactgtgcaaactggtttatccagactaagctcgataaccagaagcaaggagataaccttctaagcacacctaagatgacctatgaagagcaagagaaatatatcaaaaataatatgccagatgtgcttgacaacaactatacagatttggcaatatctctcctgttgaagttcgagacagtttatagggcaacttataatggctaaagagaagtggaagattttaccattagtcagtgaaggtggtaatggttgtgaaatgtacatgatacgtggtcatgttccagaaccaattgcacttgagatggtaaacaactttacagatggctcttacaaagacttaggggagccaactataaagcagcaatgggtaaagcctgtaccagacagcacaggtaactgtagtgtactttatcacgttgtagaccctgcaaaatgcaaatctgcaatggcagtaacaaacgtaacttttgattgagagagaaaactatgaaaacatctatccgtgttacagttcattcaccaactaaagggactcatgaagaagagtttaacatcgtccaatttccttctggtgagattggtggacatttttcaccagagtttgttgattttactgcttatgctgcatcatccatcaacaacgtgattatgattgtaaagggttatgacaaagacacattatttgctgtggcacttgctaaagaggcaattgatgatttagtacctcgtaagtttgctatgaagactgctatcttttactatttgccaaatgcacgttacgaccgtcacatgtttaaaggcgatgcagcagctttgaaagtgtttgcacaacaggttaatgcaatgggttttgatgcagtctgtgcagttgaccctcatagttacgttccagataaccttttcaactgcttccagagtattcctcaaaaggagattgcagtccactatgcaaatgaccctctgattgattacttagtagccccagatgcaggtgcttctaagaagattgcagagactgctaaagaggtggataaaccatatatcacaatgtctaaagtacgcaaccttaagactggtgaaataactggtatgcgaatccttgatgatgttgatttgacagataaaactgtcatgattcttgatgatatttgtgatggtggtcgaaccttcgtagaagcagcgaaacatcttcgtgaagcaggtgcaaaacgtgtggaactttatgtaacacatggtatcttctctaaagatgttgaaaaccttcttgacaatggtatcgaccatatttacactacaaactctttaggcgaagctaaagaccgtggcttaacacattacagtcaagttactgtagcaaaccttgattaggtaacagtatgaataagggttattttgaaagatacctaatatatgaaccagatacaggtttattaatttggagagtaaccctttgcagtaccgctattgctggtaatgtggctggcacaaggtctaagaagggttatatccaagtccagataaataagaagaggtactatgcacataatattgcatggattatgtctggaggtgagataccaagtggatatgagatagaccacatagaccttgataaatctaataataagttggagaatttaagacttagcacaaagtcacaaaatcagaggaataggggtatatacaagaataataaaactggtgtgaagggtgtaagtttttgtaaacaaacaggtctttacaaagcaagagtcatgctttaccataaagaatacttttgtggaagatttaaaacggtagaagaagcaaaagaagctgtaattaaaaagcgaatagaacttcatggtgagtttgcaagacataactaagagagagataaaatatgagtaagtcactttacgcagtaccagcaggtcttaatgcagatgcttacaaggcatcacatatatatcagtatccagatgctacgcaatatcttatgttgaacctgacaccacgtagtgataaatggtttaacagtcctttagcaattgacggtgtagtggcttttggtattcaacgttttgttaaagattacttgatagaccactggaacgccactttctttgaacgtgataaaaaagaagcaattgatgaaatcttagaagtcatgaatggtgttctgggtaaagatgctatcggtcgagagcattgggaagcacttcacgacttaggttatctaccagttgaagtatacgctgtagaagaaggcacagttgtccctatgcgtgttccaatgattgtcttccagaacactgtttcaggtttccattgggtagcaggttatctggaagatgctttctctgctgagatttggaaggcttgcaccattgcgactatcgcattgcactacaaacgtatctgtaagaagtgggctgaccttacttgcgacaacgacttacatttaccttatcagtgccatgactttgctatgcgtggtatgtccggctttactgatgacgcatttaatgctgtaggtcacttaaccagctttaaagggactgatagcttccctgctatatacacagctaaacgcatctatggacagtcttacccaatctctgatattggtagttctgtaccagccactgaacactctgtgatgtgtgcaaacattgcttgggaaggtggtaacgagttggttgaagaagaaagacgatttaaaggtgagttgcaaaccttccgtcgtttcttaacagaaacttacccaactggtattgcaagtattgtttcagatacttataacttctggagaactgtgtcagaaatcttaccagaacttcgtaaagaaattatggaacgtgatggcaagctggtaattcgccctgactctggagaccctgtacatattgtcacaggttataaagcaatccacttagagtgtgctaaaaaggcttactacgagcacctaagcaagctagaggcaagtgatacaatgctgaactctgtcctgaacatgaagcttgaaaacattagttacggtattgctggatggctactgtcagaaggctacgagatggttgttgacagagaagactttggagttgctgatacagtgatgttgaaaaatgcttatatggttggttctgcaaacgttgtaacacgtcctgtagctgaaattgatggagctattaagacactgtacaacatctttgggggaactattaactctaaaggatttaaggtacttgatgagcacatcggccttatctatggtgactctatcacgctggaacgtgcaaacgaaatcctgaagcgtctgtatgaaatgggttttgcaagctctaacgtagtgtttggtgtaggctcttacacttaccagtacatgactcgtgacacctttgcatttgctgtcaaagcaactcttgcaagcattggtggtaaagagattatgcttgcaaaagaccctaaaacagatagtggtgttaagaagtctgcctttggtggtgtagcacccatgtgggatggtgataagctgaaagctgtagatggctatggattccggagttttgcagatgtacttgaccacccagcttgtgctttacgtttagtctttagcgactctgagcagttcggttatacaactcttggtgatattcgaaacaatattgacaagcagctttaaaagtatatgataagaggctcctacgggagcctttttaatttctggagaaagacatgaaaatcaaagagatgaatattaacgttgtcttggaagaacgttgggaaaacattaagaaacctgaaaatggtcataaattccttaacaaaattttagtagcagctaaagaagaactgacgggtaaggttgcagcagcaatcacaataaaagtctgtgtaaaggtcttccagacaaccaccaatttgcacttgacgagtttaaagaaagcttctacaatccaaacaaacagatacttgaaagtaactttgcagtgtctacaagtatcgtccatgacagaagctttatcctttacaaaaacatgagaggtgagtcatgcaagcatattggatagaaattttactgtcacttggtagtgtagcagtgtttgtctaccttctttgcaagtactatgcagagcacaagaagtgtgactactgtaacggagaagggtacacaagagcaggttgttgccctatttgtggtggttctggtaaaatgtttaataagtaatttaacagcaaactaagaggaaagtattatgcgcatggtaaacgaccacgcagaagtgattaagagttcaacttctttggagacatctcaagcacagattacaatgacacctgaaatgttcagccttctgagttctggtgtatacacattcaaagaaagggcagtgattcgtgaactgtcatgcaatgcagtagatgctcagaaagaagctggaaaagagaacatcccattccatgtgcatttacctactcgatttgagccttactttgaagtccgtgactttggaactggtttaacccatgacaaagtaatgagtttgtacctgaactacggggcttctacgaagaacgactctaatgactacattggtgcaatgggtatcggctcaaagtcaccgtttgcaattgctcagtcattcacagtgtctagctatgttgacggtgttgttaataaatactctgtttaccttgagaatggtatccctcaagtgactaagcttactactaacccaacaaatgaacctaatggcttagctgtacgtgtggctgttgctgaccatcgtatttcaaagttctttgaagaggctggtaacgtatactcatactttgctgtaaaaccagaaagtaatattgtatatgatgatgtattagcagatatgaatgtcattgcccgtgaaggaggtgtttatgatgctatgattcataagcaaagctggcgttctagtggcaacaggacagattttaatgtggtaatgggtaatattgcctatccagttaatatggaagcattacttggtgatgatttcttcaaagtcttgccagaatttttccgtaggagcgtagaccttgtaaacatttacatgcctattggttcagttgctattgcagcttctcgtgaagcattgcagatgaatgatacgacaaaaaatgttatcattgaggctactaaaaagataactgaagcaattacaaaggatgttatcaagaaagttaatagccaacctacacttatggatgctgcacaggcttatgcggagttgcgtttgaactcacgagaaatgtttaatgctgtgtgtccaaagctagagtggggtggtgttaaacttgatactctggaagaagaattactaaacattcgtcgtgggattatctacgcagaagacggctcaatcatttatgaacgtgacggtaaaggtaatattaaggttgataggaacggaaacaacatccctaaagtagattatctttataacccagttgcttatgtcaagttcaactctttagagagcaagattcgtgcaacagcactttcctacactcaagaggcaagtatgttcaatatctttggcgcaatgcgtaaaagccaaattgaacagtttttgttcgtgattaatgaccgtcgcaataaaaacggtactgagaagactgtaggccgcaatcagattctgcgtggtgcatgtcgagactatgccaacgaatcaagtctgtttcacagatacaatggtattgtgtttgtattctcgactgaaaaagagttagatgatttaatcaatctgcacaaacttgataaaagcttgttaaagattgtgaaaatgtctgataaggaacaccattaccagcgcaaagaagctgtaaggggtgttgtaaaactctggaaagctgtaccggcagagggtgtagcttcatacacagaggtgtcagaagacctagatacaattgaagaaccccagctttatatcaaggcagtaggcgacacagttgatggtgaatgtttttgctcatccccagaagatgtagctaaaacaattgctaatgttataggaaaaacagtctatgttttccgaaaagcaaattggaaaaagataccagaagactggattgaagtagatgagaaactattgaatggcagcttaactgatgttcactggattaatcataacaggtatatgacacgtatctatatgaatggtgtccttgaccttacaagtagttggattattgccagaaactttacgtttaataacaagaagatttctcgcgggtattgctattcacgagatacaaacaaaaccatcttcttagaaggcaatgagaatgctgttgaggcaatgtttggtaagattcagtatgtggctgcaccgtttgcatacacttacactatcagtgttcttcaggatttgaagtcatgccttgacaatgatacaaaactatacaaaaagattaagaaagcgggtgaccgcatggttatcaaactgacaaactacctttcaaaaagaaaacaaggaaaacttcttgctttcccatttagattggaataaagtgtcacccatcgaagtgagtaagttcttaggctttgatgtgaagtgtgttccagaagggactataatttacgattaaagtgtttgacaaggggcttcaaagccccttagaatagccttacaaaatgatttattaactaacaagagagagtaataagatgactactaaaactaaagcacagattgatgcagaaatttacgaactggttaaagaaggtaagctgactaaaacagcgattgcacagaagttcaatacttcaacccgttcagttggtcgtgctgtagagcgtcatgaagcaaccttaaaaggtaagaaaaaggtagcttctaaaccagctacgaagactttgaagcaagttgctaaatcagttaaaaagaaagctggaaaaccagttgaaaaggctgttaaagaggatgtacagaaagctccggtaaataagctgcatgaagctatgcagaatggcaaccagattgagtacatgattactggcgactctgttatcatgactttcggtgcagactctgaaatcgttgaatctacccatccgaactacaaagaaatcgtgatggctgttgtatccggtgagtataagaaagctttcgaactgatgaacattcgtaagtctatcgaaaacttcactcagggtgctatcaccatcaaaggtgacaagttattctacggtgctgttgagatgcgttctactctggttgaccgtattcttcacatgatgaaaactggagataaaggttttgaacgacttgtgatgttcttcgaaaaactgatggaaaacccatctaaagattctgtagaacaactttggggattcgtatctcaccttgatgttgaaattgatgaagaaggatacatcattggttggaagaaagtctctactcgtgaaggcaagctggttgactcccacacctacagagtacctaatgatttgggtaacattgtagaaatgccacgttggatggttgataataaccgtaatgtaacttgctctcagggtcttcacgttggtgcttgggattatgttcgttgcttctcaggtgatacaattctgaaggttcgtgtccatccacgagatgttgtatctgttccaactgattacaacgatatgaagatgcgttcgtctcgttatgaagttgcagcaatcgttgataatcaacgtaaagtgctgaaagaatgggatggtaagactgaagctttgcatgtcatcgttggcactgctggtgaactaatctctcaacgtaaacgtgaaatctaataagtaatttcttaaaaggctgcttcggcggccttttttatttgtattttgtgcagagtgctgtataattgttgtcacgataaactaaacaggagaaccaatgaagaaattgattctaggtttgtgcttaatgtttacagcacacttatcttatgcagttgactgcccagagctatcaattagccaaaaagtaaacatgttaaaagcttaccagtatggtgagaataacatgggtaaaggttggggtattactctagcagctatagccttacaagagtcagagttaggtctgaaggtagagaataaaaagacccatgactatggtattttccagaatcacttgaagactgtcgtaaagcgtaacaaaattagccctaatgtggctaaaaagaaactcttaagagactttgattatgctgcgaaggaaacgcacaaagagcttgagttttggacaaaggtacatggtcagccaaagtcaaagaagactttacaaaaagttttagcatcatataatgctgggtattcgtacagaatccctaaagctaagaaatattctcaagatgtttataacaatatgaaagtaattgctcaatgtgaatttgcaacaaacatttctaaggtaaaccatgaaaaaattaagaaagtctgatgaagtattgtgccatgcttatgacttacagcctcatgagttaggacttgattcctgtgtatggactccagaacagtgcagggattttgaagacaccgcaagagaagttgtatgctcacttgaagagttccacacatcagaaccaattgtgaacgttgtggacaaagagactgggcaatccataggtgtaaaacgtgatagcttagtcatagtcaacaaagaccttgtagagaaaggtaatcttatcttagcagatattgatggagttcttacaaattttaatcacgaagattgttcaacggaattgactgatggttcattttcacagtacactaatcttcttgattctgtaagagcaaaaccaacgtatgttttcaatatcattgatgcaattgctaatcatgctgccgttggactcttgacagcgagaggtgaatctcagagaatacccactgagatgtttttaaggcataacacggagcatgactacatgctttttatgcgtggttttgggactaactctataagtgcagaaagtttgaaagtgaggatgattcagtcttgcattctgccttactttaatatagtatgttttatagaagacacagagaagaatgtgcagaaggtgaacagaatccttccacacatcaaaaccatgttagttaaacattgagagaaaacttatgaacaatatcattacggtagcactggacgttacggcaaacaaatctgaagtagttcgtaacattatcaagagcaactttgagggtaaaatcttccgtgctgtcaatgtaaaagcagacggtaacattcgggagtatcgtgcccttttgaatgttaagaaacacgtcaaaggtgctggttcaacgactgcacacaaagaaaacctgatgaccatctatgatatggggatggcttcagaattaggtgctgaaggtatcgttaaagaaggtgctccgtatcgctctttcaatctggaaactgctctcatgctttcctttacaagtggttctaaaacaactacttatctctttactgatgctgcaacggtatctgctatcaaggatagcactgtcaaagctggggtagctgctgctgcaaaagcttcttcgatggctgcaaatgtccttgctaaagtcctcggttaaggttaagatacaggctccttcgggagcctttttcatttcaggagattgttaaatgacatttaaagagttctgtcaagctactttcataattgttttcttagttggggcaggtgtctggggaggatactcttacagagactatcaagttgctgaaactgagctaaacaatcaaaagctcataagtgttgctaaagatgcttatcaggaaggattagtcacactgagcaccaattacaaaaatgatttgaaagatgtgcttgctaagaataagcatacaaaagaggtactaacatatgaaaaaactaagccagagttttataatgtttgtgttactgataactatgtcagggtgttcaacgaacaaagtgaacagtacattcaaaaactcccaagtaagtgagagcgataagtacactcaagaagagtcacggtatatcatcaaaggcaacacaggcagtgatgtagcagcagcccttgagttctatcgtgacggcttttaccagtgtacaatcaaagctaataaccttattgatatgattttattagggaataagcagcaatgacagagaatgaagatactttttacgtagaagggtacttactgttgccacgaccaaaagaaacttatatgcgaattgatttcttaccaaccattatggataatgttatgtgtcatatctttatgcaaggtgtcacagcacagcttaagtatgttggtaaagagtgcaaaataaaggttgacactcatccagaaatcaaagagaatcactacacatggttcttaccagactctaaagaaatcttagcagttcttaaaacgaggaagtaactatgcagattaatggaagagaatttgtagccgtttactatgagaaaggtaaagaagttggcgtagcacaagtatcttatggcaatggtaagtggctatatggaacaatcgcagtagtaggaacaagaagtgatacaaaaacctttaaagattgtgttgaccttcttgaagaatccatccagaatcattggtgtctgatatggatgactgataacgaagtgatggagcgtttcaaaaagattggtgtcaacattgacagtattgagcatgttgatttatatgagctaactgagatggtaaactatgaaagctctagaggtaattgataaagacactggagaagttacatcagcatgtgttttcgttagtaacgacacagtgataccattttacaatctcgatagttttagttttacatggataactccagaagaatactttgaagaccttacctttgccagaatttctatagatacattctataaatgcttctatgatgaaggtaaagaattacgagaaactgaactataaggtatatattatatggctgacttctgcaaagactgttctatcgaaatgttcggacgtgatacaggtgacttaaaaggtcttatcactgaagatgactttaaagctggctatgcaatgccagtaatctgtgaaggctgtgggtgcatctgggtagaccacgaaggacaacgtgtaaagccttccgaagataaagaatcttgggagagatgttaaatgggtattgtaaaaattatcaaaggtgatatctttgacgcatttgataaaggtaagtttgatatcattggtcatggttgcaactgtatgaatttcatgggtgcaggtattgcagcaactatttctaagcgttatccaaaagtgtatgatactgacacagaagtttacctgtttgcaggtggcatccgtcacaaaccctgtgaaaatttactaggtaatttctctgtagtacgtttaaaacaaggccgtatagctaacctttacacccaacttcatactggtaaagatgcccgatacagtgctttagagtcatctttgaaacagcttaacagatactgtgaagtcaaccagttgaagaaggttggtctacctatgattggtgcaggtatcggtggacttgaccctcaagctgtcacagttatcatcaatcaggttatgaagagcgtagatgtttatctgtatgtctacgagacagagatgtacaacgagttacactcaggttggaaaaactactgtgaaccagaatactttgcaggtgtagttgtgttcacggacaatacagttaccctcttcagacgaagaaaaggtaagatacatcaaagtaaccctccggttgaaaagatgtctctaagtaacgctctagttacccacctgtcgaagagcaatcacagaattgcagtaacatttggcagtgatgcagatacttatatctatgcaagaactgatgaggatatcgagttaatcttctcttcaccagagcttaccttcttagacgcaaagaactaagaaactctgtagagtattcacaatagactaagcctttcttatctggtaaatttttcaggtaaggagggcttttccatttcagaattgtgcaggtagagttctgtagagaaatctgtagagagaattctgaactccaaagagaaaattcattttcaaactgtgcagataatctccaaaggactttttcattttcaaaacgtgcagagaaaaatcaggtcgggcaagaaaaatcattttagaattgtgcaggttggtggtgtttatttacgtaactcttccagattcaaatctctgaaagctgtttatgatgaccttgttaaaagctctgtttcaggactaccctatgcaggtggtattaatcagtgtgatattgacatgcgtcgtcagaatccttgctctgtcaagaaatacacagaatatggtgatgctgccagatacgaaggcagagattactgcaaccgtgttaatggcgtatttattatcgagcgagatgaataatggttaaaagggttattcaccccgctagagcaaaattagtcggggctatgaagaacttgcaaacggctaatgctcaagttgggtattttcaagaacaaggtcaacatagctctggtttttcttatcctgctttaatgtatttgcaagaagttattggggttccttcagcttctggtaaagtgtatcgtaggttgtttgaaatcactatgatgctaaacaaacagaccttgttagagcagactaagaagaatctatataagcaacttagcagtctcaacacagacccttcaaataccttagaagcatttgcaaagaatgctcaaaaggcaattaaaaggggctttggtaattctgctatcctccctcctaacgcaccttccacagtcaagaaaaaaggctttaatgcacctcttgttgagacaggtgacttaagagataaccttgcttataaaatttctactaagaagggtattaagaaatgagactcttaaacagacacagctttgtagtaaagcgtaaagtctctgaagacggttattacaatgatgatggtgattgggtagcttcacaagatattgtagaggttaactgtaaaggtaatatccagccatatatcaaaggttctgtaaagaatggtacacagattgctttaccggaaggtatcagacttaccgatacaagaatcctgtatactacatataaacttagaacttcagatgatgtagagtggaatgagtctgatattgttatgattgatggtcatgagtatgaagtatttatgactatggattggtcacagcaattagcccatacgtcccattatgaatatatcattattagaagggataaaatgaatgcagttagaaacagcagaacttgaaaaaggtctagttagaaccttagtggatgttattggtcacagactggctcgtgataaaaataatagaccgaatgtaattagagcttacccttctgataactcaaatgacaaaggtttaaaacctgaccagccatttattaccgtatactgtcaagatgctgcaacaccttatggttgggttcttgataagtttgttgaggatgatgtagtttgctacagaattgcttttcagattccagtattaattacggtgaatggtaaaggtgctcacagtattatgcttgagcttaaacaacgattagagatgagttcagtcagagatttaatccttgaagagacaggagctacagtactagacactggagctatcccgaatgactatacttatctcaatacagatttcgaaaattctgcgcctcttgttgtaactcttgtaaaaaactcagtcctgaaggatgaacgtggaagtattattgagcgtgtcattgttgatggtgagttggtttatgaagaaggacaagagccaccagaatatactatccatctagatgtagactccaaaggggtaaaataaatgtggaatccaattgttaatgtagatattacattgaacaccgcaggaactacaagagaaggttttggtttgccactattcttagcttcaacagataactttgaagaaagagtgcgtggttacacttccttaactgaagttgctgaagatttcgatgaaaatactgctgcatataaagctgctaaacaactttggagtcagactcctaaagtaactcagctttatatcggtagacgcgctatgcagtacactgtatcaattcctgatgccgttaccgaaagtacagactactcaattactgtagctgctggcggtggaatttctcaaccataccagtacacagcacaaagttcagacactgctgaggtagtgttacaacagtttaaaacacagattgaagctgacccaacaatcaaagataaggtttctgtgaatgtaactggtagcaatggctctgccacaatgattattaccaaagctggtgataatgactttgtgaaagtaacaaccacagcacagactgtatatattgcaagtacaactgccgatacagcagcaactgctctggcagccattgaagcttattctactgactggtatttcattgcagcagaagacagaactcaacagtttgtcttagcaatggcttctgagattcaggctcgcaagaaaatcttctttacagctaactccgatgtaacagccctgcaaggtacagaattagccagtgcaaatgatgttccagcacagcttgctaagaatatgtacactcgtacagtttgcttgtggcatcacgcagcagcagaagattacccagagatggcatacattgcttatggtgctccatatgatgcaggttcaattgcttggggtaatgctcagctaactggtgtagcagcttctctacaaccatctaatcagagacctctgacaagtattcagaagtctgctttagatgtacgtcactgtaactttattgaccttgatggtggtgttccagtggttcgtagagggattacttctggtggggaatggattgatatcgtccgtggtgttgactggttagaatcagacctgaaaacttctctgagagacttgctaattaaccagaagggtggtaagattacttatgatgatactggtattacccgtattcgtcaagtcattgaaacctctctgcaaagagcagtcaacagaaacttcctgtcatcttacacagttaatgttcctaaagcctctcaagttgctttagcagacaagaaagctcgtatcctgaaagatgttaccttcgcaggtatcttagcaggggctatcttggatgttgacttgaaaggtacagtggcttacgaataatagaggtaaattggaatggctatgtatcagcaatattcccctaaagacgttgtatgtagctggaatggtattgccattgaagctttgccccagactcattcttgcgtctacagagaacatcaccacttgtgacaccagttgttggtgcaggtggtcaggttgctctgacaagaaatgcagacaagacaggtactattgagattgagctaatgcagacttctctctctaaccagatgctttctgcaattcaagctaaacaagacaatatggaacttgaagtagatatctcttctaacttcgtaatctacgacccatcaggctctgttctggcaactggtattaatgcttggttgcaggagttgccacagattgaacttggtcgtgaccagaactctaaaacttggatttttggttgtgagaagctagactatacttctacaattccagcgtcaagtgtttaataaatcctataagggggagactttaaaaggtcttccccttttttgtttcttttaaaagtattaaggaatcacaatgaaaacagaatttagagtaattaatggtaagaaagtaaatatcgttctgctggggcaagagatggtattaagatgtctatgaagttgggtaaaattgttgttccaacctttgcacagatgctatcaagtctgactgacaaggataagaaggaagctccaatggttccatttaaagaacttgttgaagcttgttttgacagaattgaagagattaaccttgaagaaatggcaactctgttatttcaaggggcaactgttgatgacttcccacttaatattgatacgtacttccaagcaaactatggtgagttcattgattacttagcatttgcgctggaggcaaacttcggaagttttttcgaagcaagcattttcaaaagcctaacttctcagtaaacatgggcaacactctacagacaccactaactgatgctgctgtagaggcaacctatgaagaagcagacgagatgaaatttgtgcttgctatttatggtatggaagggtgtaaagaaacacttgaccaactctttgctatgacattctctgatttattatcattgagacaatttcttgaaattcagaggtcgtataaagaggaaattgcttacaacgaacttagaagagcaggaaaaatgtaatggcacaatatacagttgatagcttcattgtggaacttggtttcagtgaaaaggttattaagggcttgcaaagagttgagaagatgtctatgcaagctgctcaacgtattgagagaaatattaataaagcctttgatgtgaaacctaataaaagctctcaggaagcacttaatagaattgtaaaaaatgctcagtctgcttcgggcagaatcaataaagcactcaacagttccttgaaccttgattcacaaggtgttaaatctcttaagaaacttgaaactcaaagcaaaaaagactgcaaaaggtattaacaagtccttaagagatgctatgaatgttgacggtaaaatcactattaaaacaggcagagggagaggtggacagagcatcccccctgttggtggtggagcacccagaggtcagagagtagatgttgctcagagacaaatggaaaggatgtttaataacaacttctattcagggttaacccgtagactggaaacaattggtggtcaaggtaaccagatggcagcctctttcagagggagcttgcaaaatatctacaacagatacaaagggactggtaaggttggtgagtatgagatggaagttaaaaagctcatcgacgtaaccaaacgttgggttattgcagaaaatgctagattaaaatcagttaaagaatcagcttggctacaggatagagctaacgcatcattacgccaattagttggtggatttgtttcagcttacgctttactggaactatctcaaaagactattgaagctggtgtaaaaagacaatctgcacagttagcctctacagctatctttggagcagatacacagcaagctagaatgttcgctgcatcattcgcacaccagattggtcagaactacacagacactatgaagcagtactcaaacttgctgctggtgctcaaccaacacttggttttcaaggtactcaagagttctataagaatgctgcaatgtttgcccgtatcaggggtgctactgatgaagacttgaaaggtatcatggttgcattccagcagatggcatcaaaaggtaaagttcaggctgaagaactccgtggacagttaggtgaccgtttagcaggtgctgtacagctattcgctgatgccattggtaagaccccacaagaacttgataagatgatgcaagatggtaaactgcttgctcaagacgttcttcctaaagtatctgaaagaatggctgaacttgtcaagcaagcaggtggtatgaacgctgtatctaagcagaccgctacatcaatgggtcaagctaaggcaatgtgggataacacacttgtagcactgtttaacaactctagtgagggtatttcacagttatctaactctgttgcaatgttcttacaaggttctatgggtagcacacaagctttgggtcttgtgattgggagtctcttaaaaggtgctagtaatctacttgacttcgttacagacttcatgtacagaacatctgcactatactactatgcaagagcttggtataaagaccttgacaacagccagcaaaaacttatcaaaagtgctggtgaatttctgggaacagttgtgacaattggtggtgcagttgctgtagtatcaaaatcagtcaagctcctaagtggtttggttggtggtggtatctttggtaaaatcttacaaagacttggtgttagtgcagcaggtacagcagcagccggagaagcagccgcagcagcaggtggagttacagcaacgagaatggcacttggtactgttggttcggcattaatgctaagaggttctacagacccaaatgctgctaaaaactacagtgaagttacattaccaaaaccatttgaaaatgctgttgcaaatattacaaacccaaaaagaccaatgttctttgatgagaatggtcaacttcagtttgcacagtacactcaagatgttgaaggcaacagaaagttaattgacaatggcctatctaattgggagattatcatggagaagctatcaacatccattgataattttgccaataagtttaaccagacaccaatgatgatgacaccttctggtttacctatgcagactaaacaaaccctgaatgttactttcaatcttgatggtaaacaaattgctactaagatggtggatattactgacaagaatcaagaagacattcttctaagtcaagctatccagaggaagaataatgttatgggattctaatatgcaaatcaaatatagtggcaaagatggcatctatttccacttaagagataatgtagatgccttcttaaccttatcagctactgaaaacatggaatttgacagccctatgcaggtgactacacagaacatgcaatcagggcaaactgtcacagataatgtgcagagagcacccagaacaatcactatcagtggtgtcgttgtagttggctatgaagggagcttattattaactcgtcagggtcaattagtagaaaacttcattgacactctggaaaactggcgtgaccagaagcagattatttcagtcatctgtaaagatggtattaaaattgatgattccattattacaagttttaaagcctctaaagatgttggtatttcaaatggtctgagaatccagctaacttttcaggaaattaactttaaagctattgtagggcaaactgatgtttcagcagctactggaaagaccgctaccacgaatgatggtggtgctaccagtaaaaagaatacagggaacactacgacaagtttaggtaatggtaaattaaactgtcagctactatttgacctagatgctaatggtgtaagggaactcactagtgctgaaggtaatgcgcttgggaaatgctcaatgtctgcgaagacaagaaaaggtgtcaccacatttagtgacgaggctgaaagaaatgctggagcagcgttaaataatactgctggaactggaaaggcattacaaaagcattcagtgaatccgaataagaaggggacttattaatgtcacaatatattcctgttcctgatacagagtggtctacacaaactgtaactctggatggtactgtctttataattgagttaaagtataaagagaggcttgacagatggttcttgacgctatctgatgttgatggtaatgtattattatctgaaaagaaatgccttgcagaccagtcaatcacaggacgctatgtaattccttcattagctggagagctttttgttgaacgaatgtatggtactgatttacaacctaccagaaataatttcggaagagaaagggcatttgagcttaattattacactcaagaagatatgagattaatggagaatttataatgtctgtaaaagatagcactgctggggcttcttttaggtgctatcaattggctgtaggtagtgaaactacagcctttaatgataaacctacaagccatgccaaagattctatgcaaatggactatttcgacaacttacaattcacttgtaacgtgtcttatacgtctcagaaaaataaagtaacctccgatgacaccacttttgaaatctacaacctaaataaagagatgagagccaaataaaacagttggtgcaacagttatgctcagagcaggttacaccactggctttaaaagagacgcaaatggtgaccttattattgagtatgacaacctcccattaatttatctaggaactattgaatatgcttatacatataagcgtggtgttgatatggttacaaaggtcatctgttccaatgataaaatggaaagaaccacgattaagacatcaatctcttataaagcaggtacaacacgtaagagtgtaattagagatttagtcaatagattaggcttctcacttattgatgaagacctttcaagtattgatggttacacttacaagaatggttttagtgtttggggaagtgttgcagaggcacttacaaaggtttgtgaagaaagtagtctacgttggtatacatttaacaagcaaatcagagtagtcccttttaacgctaaggctagacaactttcttgggaaatttacccgtataatgttattgattctttgcaaggttactacagaagaactagaaaggttctgaaaaaagagaataagacagttattaaagttaaaactggagttcgttgcaaaatccatttagacgggagaattaagatgggtgatagtgtcacaattagagaaagtgaagattttgaaggtcagtatcgagtaaaaggtctttctcataatcttgactttactggtggtgcttggacaactgaactagatttagagaaggtggaataatgaagtcaccagttactagaatgtctgggtatgtttcagaatgtcttgatgaatttagaaaagaactgtatactggcttaccagctattatccagtcttttgattcaaagactcaaacagccactgttaagccactttactctattaacggtttacctatgccagagattactggtgttcctgttcaatttccaagtggtggtggcgcatctttaacattccctgtaaaaactaatgacagatgctggctagctttctcaatgttacctttagatgacttcgttgtcaatgacaagaatactcagatggaaacaaatatgagaaggacacacgatatctcagactgtgtagctttcgtaggcatctgcacaagaacacagaattttaaaccagacccaacagcagtcagacttcatttcggtgactctgtgttaagagttacagatgatggcaatttttattttgaaggtgatgtacacatttctaaaaacttgtacgtaacagaagaagtacatggttcagattttatcagtgacacgactggtgtgagctttaatgaacacacgcaccattattactggacagaccctgctggtgaggctgatactacagaggcacaataatgaaaacagattttgcattaaatctaggtggtgactatgttgccactttaggttcagattcagtgtatgtggctcatggtgatttaaagattactggtaaccaaattagaattatcccagaagatgataaagctactcaggttgctcaaagacttcatatcagatgccttttaagggctggtgaagtcttctttaacacatctgctggattcccatatttacaacttgccaaatttaaacagaaaacttctatctttgataattatatgaaagcttaccttgttgaaacaagagatgtatccaatatctataactactcgtcttcaatggacaatgctcaaagaaaagtaactgttaattttgatgcaactactacaacagatattttaacagacattacgcaagaggttaatatctaatggcaggattaactacaacaggattacaaactctaagatatcaggaaatttttgataatattaaatcaagacttcttagagatatttcaccaaaccttgacgtttctgaagatagtcaattaggtctctttctggcttcaattgcaaggtctttagcagacacccatgaagtcctgtcagaaatttatgatggtgggacgattgataaagcggaaggttttaacctcgatgatattacagctttaaacgccgtatacagatatgtggctcaggctacaagaggccaagtagagtttactggaacaactggtgcaacaattccatctacaactagactaagaagcactgctggtaatatcttctatccagtttcaaacattacattaacaccttcatattgtgttgaagctgttcttgaagttaactctttacgaactgatgcagattatgttattattattgataacgttattttctcttatcagccaaaatcttcagatacaatcacagtactattaactgaacttgccgatgcaatcaatggtggtatcgtagcaaaagccgaagttatcaatgacggttcagcattacgagtttataaagatgaaggtgacattattgccagaaccaaccctatggtggtgactgctacgacgttccttacattcacaaaaattacaactatcaatgatgttgttgctgaggaagttggtgcaatccctgcattagctggaacacttatcgaaattgaaacaactgtagatggtcttgacagtgtatacaacagatatgacctgacaacaggtagaaatgaagaaactgatacagaacttcgacagagatatttagaatctttggcagttactggtgtaggtactcttgatgcaatcgtagctgctgttaaaagagttcagggtgtatcagatgcttcaggtgtggaaaatgatactgaagagacaagttcagaagggcttccaccaaagtctttcaagattgttgtagttggtggtcaaaatgataatgttgctcaagcaatctgggacaccaaacctgctggtatcagggcttatggagctatctttggtacagcttatgacttaggtaacttagctcataatgtctattttagcagaccaacacccaagtatgcttttgtcaaagtatcttattctttatatgatgaagagagcttaacaatcccagaagaagatatcagagatagtattgttcaaggtattaacgcttacggtagaactttgaaagttggtaatgatgttatccctaacagaatctatgggtatatttatgatgtcattaaaggtgttgagattaatgaaatcaaagtagctctttcaaataaccaatcagtacctcctagtgatgggcagtatactacggcaagaattactgttgatggtgaccaatatactgtatgggaaagtagtcagtacaccattgctaaggagtaataatgtttcagaaaattgataacgtttactataagactcttgatgaaaggactgtaacacagtttaaagataagttcatctacacaagcttacttaaagcgattactgatgagttgcagacattggaagatgtttcatggcaaatgcacactgaaaggaatatcagaaaagctgttgggcagcaattagacaacattggttcattaattaaagtgccacgaccacttggtgctgatgatgaaacatacagagcaatgctgtatatccaaatttttctaagacgttctgacacaactccaacgtttttacagaatgctatcatgactctgtataacgcaacattttcacagatttttgagcatattacacctgtgactgctggtattgtagtcagggttaatacaagaaataacgtcattgatacagcgtacacattagcaaaaattgctgcaacaactattggctcagcagttattctaagagacgtaactctgaatgtactgcttggacacctgtagaggtggctgactcagccttagcaattgttgatgataaagataactggttcgttacagatgctaacaagggtcttgttactaacaacacaggtggttctttagataagaacttactaggtagcttgacagatgctggcgtaagagatgcttatttcgaggttgataggacggctaatagtggctcagtagattacttaaaagttaataaaaattataacgctacagataactacatcgttggtaaagaaactgcagcaggtggtgattatggtgttatggctgaagtagctcaaatcatcaaaggtagaaaagataaatcacagcaagaaggaagttcttaatggcatttttaaattggtctacagatgaagtagatgctgatggtaaccagctaaaagtattaccaccaccagaaattcaggccactggtttattaaggggtgagcctatgggacgccaatggtttaactatatcttaaactatctcctgaagaaagcaaacggaactgttggtgaagtaaggtcttttgccactgagcaaccagatttagtagctaatggctggagtcttattaagaccgaaacaggtactgcatcaacaagtacaaaaaacctttacacttatgaatttgtaggagcttaataatggcagtaggtgaaattcaaattagtgccttgcctcaagcagccttaccaattgaccttagtgatatcttccatcttaagcagggtattgaggataagagatgtactcttgagcaattacttgctccacactcaagcctaagaaataaccctcacggtgttactaaaacacaaattggtttagataatgttatcaatgctcttcagttagttgctgcaaataacttatcagatgttgctaatgtcactgaggcaagagcaaatctacagattatgtcttcagaagaggttaatagccttgttcaacagcatattaatgataaaagtaacccacacaatacaactaaggcacaggttggtttgagcaatgtccagaactgggtgacatctaacctttataatgaggatgcagataagtatgctacagcaagagcagtaaataacttgtacaaggctgttcaggcttcttatccagtaggtactatccatctctctatgaatcctgcaaacccttctacatatttaatttgtggaggtacttgggagttagtttcaagaggaagagcacttgtaggttatgatagtgattctaggccagttggtagtaactttggctcaagtagtgttagcttatctagtaacaacctaccatcacatagccattcaatctacctaactggtggtggacacactcatggtgctgctattactattgatggctttgattacggcaataagagcacaaacagtttcgattatggaacaaagaccactaatagcactggtgctcacacccactcagtgagtggttcaacaaataccacaggtaatcacacacatactgtaggtggtcgttatggtggtgactctatcggtggtaaaccgcgtgttcaggtatctggtacagaacaggtttccagtgtagctggtgaccactcacacactattagcggttcaacaaataccacaggcaatcaccaacacactgttgcaattggtgctcacacgcatactgttgcaattggtgctcatacccataaaggcacagtaactttgcagtcatctgagcatactcactcaggtactacaggtactacaggtgctggtcaagcattcagcgttgaacaaccatcctttgtggtttatgtatggcaaagaaccgcttaaaaattcttttacagggggctgtacagccctctttctagaggacaaaaataatggcagattacaaattgagtgaattaaactcaatcgatacaatccgttcagacgaccttcttcatgtcagggttaaaaagagacctgaaatgctgggtgatgaagaccgtcgaatgacctatcaagacttcttagcatcttttaagcttgaaagatttgttcagattgctggtagcactatgactggtgacttagggattgttaagttactttatggtggtaaggcagtctttgaccctacaggctcttctgagattactatgggggatattttaaagacttttaaaattaacgcaaatggtcttaaattaactattgcagatgcttcaaggtcagcaactgtttatcatactctgaataagccaagtcctaatgagcttggtatgagaactaatgaagagaatgacgcaagatatgcaagacttgctgttacaaacacattctctgggactcagaacattcaaggtgatgttaacttacttcgccttagaaaccaaaatgcaaataatgcacaatatattgaaggtgtagacctagatggctcggctagatggttggttggtattagcaaaaatggttctgatgcagtgcagttgtacaataacaaatatgactcagctttgactattgcaagcaatatctctgtgaataagtctctagcaatcactggtcaagtacaaccttctgacttctctaacttagatgctagatactttactcagacagcagctaatcagagatttgcacagttagctgttaataacacttttacaggtgctaatactttcactaaccttgttgttaagaagaatgctaatgctattactttgcagaatactgatgcaggtacagcactttatattcttggtaagaagtctgatggaacaaataaatggtatgttggtacagattctgatgagacacgtctgaatatttataactacattacaggttcacaggtttcactaggtactactgttggtattaataaaaccttgcaaatcaatggtcaagttcaaccatctgattggactaacattgactctagatatattccggcagcaacattaagtacaattgcaagaactaatactctcaatacattttctgtacgacaagttatcaactctgatggtgaagctcttgcgttaaaagcaaaaactgaaacgacattgttcattagggggtgggctgctgatgggacagctaagtggtatgttggtaatggtgatgccgataacaataataacttaaggctgtttaactacaaaacaggtaaagtgcttaccattggctcaacattcgaaatgaatgcaactttagcaatcactgggcaggttcaaccttcagattggtctaacattgatgcgagatactacaacaaatcatctgctgataacagatatctgagagtaagaagcacagatttcaatactagtggtgctggtaaatgggctaagattgcaactgtgaatatgccacaaggcgcatcaacagcagtgattgaactgtttggtggggctggatttaactttggcctaattgaccaagcctgtaagacagaaattgttcttaggacaggggatggtaacccaaaaggcttaaatgttgttgcatggaaaaactcaccgaataatgatgtaagtagaattgggtatgttaatacctctggtgataactatgacatttattgcgcagttggtaactatctagtcgctacaacagctagggttcagtcaacatctaatgcaacagtacaactgtttgaggctccagagacatctgacaacgctccatctggctatgttgatgggacaattgctcactattacactagtctcttgaagccaacaccttcagatattggtgcatatactaaatcagaaactgaccagaagattgcagaagcgattagtgactctacagacctgaataaaatctatccagtaggtattgtgacatggtttaacagtaatgttaaccctaatacagcactccctgggttaacttggacgtatctgaacaatggtgttggtagaactattagaattgcagcagcaaacggttcagatgttgctacaactggtggttcagattctgtaacgttatctgttggtaacttaccttcacacactcatagcttctctgcgactacttcatcatttgactatggtacgaaaaccactaacactactggtgctcacacccactcagtgagtggttctactaacaacactggtgctcatacacatacagttggtggtcattatggtggtgactctatcggtggtaaaccgcgtgttcaggtatctggtacagaacaggtttccagtgtagctggtgaccactctcacactgtatctggtactgctgcctctaacggaaaccatgctcacacagttggtattggtgctcacagtcatacagttagtggtaacactggtggtacaggttctggttcagcatttagtgtaactaaccagttctataagctgatggcttgggtaagaactgcttaatcccttattgactgattgttaagatggtgttaatattctttatgggtattctcaccatcttgctgatgaggtgattaaatgcctacaatcctagcaattctcctaaaaaatctaggtagcttcttctggaaactcattttatcccttctaagtgaatacatgattgagaaagtgttctttaagcttgcaagataccttgcgggtaagacagacacacctattgatgatgagttcgtagataacttagaaaaagcttttaagggggagaaataaatgaagtggctagaggaagcttttaaaaataatattggtgcaattgttgttggtatttttagtgttattgggatgtataccacgatgcaagtttcaagtggtaagcaagaagtgtctgtcacaacaaagttacagcagctagataattattccagaagtaactattcagctattcgtgatttacagtctgacatgagactggttcagctagggatggagaaccagaaagttcagttagagaatgttaagggtgaaaacgcaaaacttaccaaaacccttgataaattctctgacagtgtaaataatctggctcaatcagtatcagccctccaagctattactgagaagaacacaaaagaacactgaaaataaaattttaaggctcctttttacgggagcctttttgttttacttacctactgacaaaggtgcttcaatcttccctgcgtgtttgtagttgttaataccaccaataaaatcactcgcagtaaggtgttttaggtcacttagcgtgttaagtggtagaccaatctcaaaagttggtgcatggaactcttcattattcatcaattcataaacctgcttcatatggttctgataaatctgagtatccccaaagacacctatcaagtatcgtggagtgtacccagtcatcttgcaaagtacttccagaataaaaccataagatgcaatgttaaacggaagtcctaaaaaggtgtctacagaacgttgataccattgtaagtcaacttcaccctcgttagtgatataaatctgaaacagaacatgacaaggtgctaaagccatcgagttggatgcaatatctgctgcattccaagcattaacaagcatgtagcggtctgtgatatcacctttcatcttcgttactaaggtctctaactggtctacaacacaaccattatgaccttcaaagtttctccactgaaccccgtagattctcccacctgcatcttctaaccaatcttgttcagaagaataattagagcttaaccagcg

SEQ ID NO: 5 - DNA, 29354 bp, Artificial Sequence
  Bacteriophage San 23 Contig 2
agctttcagagatttgaatctggaagagttacgtaaataaacaccaccaaccttctcatctcccatcttggctacttgaaagagtaaatatttaagagctttgatggctgctttcttttcatcctttccagattctagatagaaccactctagcacagactgctcaataagaatttcatcattattagtgtctgtgcagaggattcttactctatcaagagggttattggctgggtcgcctgtataacacattcataaccctcctaagtttattagctacctttagcgtcagcgcgaacatctaccagcaactgaggacgagtgcagtatggcagcatgtaagagtgagcttcgaagtcaataccttcgtcacggtcttttcgtattcgaatacgtacagttcctgaccaagtgtatttgcgtaacccatcttaggacatgggccatatgccacttcgaagatgttgttagcttcacccagcatagatacgttagggaaggcatgaccaacaccaacagttgctgctacactatcaatgctcaccagagtgtgaaccttaccacgcttgtctttgaacttaccgttgtactggacaaacttaacaccaccgtagtagaaggtgttcatatgagcctgaacgccgtcagtaccaccagttctcagagaaccagtaatctgttgccaagccagtggagtctgctgtgcaagataagcgtcacgaatcttaggatgcttaaccagtttgctgaagaatacacggtcaacaactacgtgaatttcttcaccgttgattacagtgccagtcttagcttcgtcttccatgtgcatacgcagttcttcgatagaagcgtcgatgtcagcattagggttgtcaaggtcgaagtaaatagtcttcttctcaacgtcgaactgcttgtacaggtcagcatacagagtaccacgagcatcaacaactttacccttcagagcttgcataaacaggaactcacgagtaatatcgaacttggtacgaatcttcatcagcttcttagcacgtactacagcttcagtagtcagttcatttgcagtgcctggctgacgtacaccctgaatctcatcaggagtaatgctttcaacttctttgaagtacatcattgggaagctgatttgacgaacacgctcaggtgcgctagtctctgctttacggctatcacggtctaccgcatcaagcaagctaacatcccaatcagtcaagtccatcaggaaagtagtttgggtgattggtgctgaacggaacagacctaagttggaaatataccataagtatttgggatagactggacttcaccagtcaggtcagcaaggaaaaatctgcttttttcagaattagtcaacattgtaaaattctccagaatgtcttattattgttattacaggccagttggtacgaaatcaatacctttggcagccagagctttcttgactgcggcagcgtcaacgcttgcttcaagagtcagcatgtctttcagttctgcatcacggtggataccaacaactttcaactgaccatgataagacagttgcaggtctgcataaaagttaacgatacatactgaatcagcctgagcttcttgccctgctgtaaccttagtaccatctgctttcagaacttcacctacacggtattctgttgaagcaaccggagtgtactctttgcgagagtgacctgttggggtaacctgttcccaaagaatgatatcattcagaggttctctgttacctaacttagtaaaaccttgatatgccattattgtgttccttatttgataagagattttagagcattctggagagccagtttgcgttgttcagcggtgtcttcggaagcattcttagctggttctttttcttcttcaaccaaatcagcttcgccgtcattacccacttcttccatagcattggaatgttcaagaacagcaccagcagtttctttcagcttggtaatttctgattctttttcttccattgcagaagcatgggacgcgatagtttcattaagtttctggttagcaccttccatagcattcataaacagaacactcagagggttatcaagaccagcacctaaaatagtcgttgcagcttcttttgcatcaaatccaaaagcttcagcagaagcagaaatcttattagtcaaatctgacaaagcagcttcctgttctttagctttcatttgagcaacctgaagacgcaaagcttctagttcttgcttttcttgttcagtcatttcttcacctgaattgttaacgtttaaacttacaggagcctcttcagaaccttgtaagtaatttaagaaatcatcttgagacatgattgagttaattaaaccaagttcaagagcttcctgagcagaataaacattcgcctcagtattctttacagcttcttcagagagattacgagattcagctacaaaacctgtaaaggttgcgtaggtatcattaattctcttttgaagtctttctttgctttcttctgaaagtgcttggaatggtgaacccatacctttaaactcaccagctttgatgacgttaattgttacgccattcttttcaaatgctttagttaattcctgatgaaccataattacaccaatagaaccaacatctgcatctggtgatgcaataatttcttcagcagaagatgcaagagcgtatgcagcggaacaagcgaactcatctacataagcaataattttcttttggcctcttgaagccataatgtgacgtgctaattcaaagcaacctgaagcttcaccaccaccagaatcgatgtgcagaacaatagtcttaattgactcatctgctaaagcttcgtcaaagcctctacgtaaaccctcataagagcttaatccacctgtacacattgcatcaatgaatgtcatacgatgggttaaaccacccataatagggataatagcaatgtcatcttttacttttaaaagacttcttgcttcacctttgggtttatcaaagtttactgctgcttggacatcacccagcaatctgttattcacataagttgctgctgagtgagctaatgattcagtggctagtaaaggttggttgaataatctatcagcaagtctgaagatattcgaactcatttttactcaccctatttgtttaaatctacagagactgaagagataacatagataccttcttcagcaaagaattgaggtttgctaagagcaccagttgccacgcatttatcgttagcatcccacaagctatagtgtgagaccgttgcagaagctgggacagtaatgttaactgtgtcttctgaggcaattaagccattatccggttcagaaaaataaatagccactggctgagtaaccttatttgctgtagggtctgccgttgggtctacattgtgtaaaataatagtcgttggggttagcgtggcgaggattttattcttaccatcaatagttaatgttcccattaattaaaccttactttttgtttaaggactgttgaatggttaccagattcatctaccacatttacaatcatatcatatactttgcctttgacaagtactttgtaatcattttgtgaaaaaatgtattcaagtctgtttgtttctttattaactgtcattggagattgaaatgcagtgtcgagggtaatgaaagcggcttcaatgctattaacattgatacgtttattctcgcagttatataactttacacccaaaaggcatgaactgtcaaatggaattttaacaatttcactacaatttcctgaaataaacggttttccactcattggagcatcaagtaacctgcaaatagtgaaaacgtcagaggctccaccatcgcttacataacctgaaaggctgacccttgagccagcctctacagataacttgtcagtaatgataagaacacctctatacgaatgcacccgtgtagcatttgaaatagagataacttcagccattatttatttgccttatttgctgtgcttgggtcttttgctgaaggtgtctttgcagtaccttctccagcagtcttatagccatctcctgaacggctttggctatttggagaaagcttttcagatactggttgagactcatcagcaggaggaagaccaatatgctctctaagcttgttagatagctctttgtcaacttccaaagcacctactgcaacagtcttctgaatataagaaccaattgcttcaaggtctggagtttcgatatcatcatatgtgatttgcacatgttcttcatcatcccacatattaagagcgtaagtctgtgcaactaaatcacggttaattacgttcttaatttgcttcagcaggatatctactgacatcgctaataagcttgtcttagaatctgcaagagagaatgaaccgtattttgactgacccatagcaagaacatctgacataaatgccatcataatctgcttggaatatctgtcgataatagaacctgtatcgtatgctttagcaccctgtctagaaactaatgagaactacaaaaatatcctctttagtatctgggtcgatatatctaggccagattaaacctgctctatcattagcaatcatatcgttaacaacagttttgcagtattgtacgaaagctttcttttcaggttctgcattttcatccagataatctggtggtaaaccaatctttggcatacctaccaagtctcttgaaacaccaacggcttcgtactcttcaatctgaactttatacttccacggtacataggcattaagtaatggtgaacgaccttctgggtttccatattcatcatcatacttaaacagcatgaatttagctcgtgggagttttcttgttagtggcctttctccgagattaattgctccagcaatatgtgaaacatttctcagattctgcctaacaccagtaacttttctaaagtcttcgtcaaaataccacttatcaagtgttgactggtttctgattggtaatttagcccatccaattagaccatcatcaaattttgactggtactttcctttcttaccctgacgcttcttataaactttctcgttaacacagaacccataagtgcagaatgacattacagagttaataaaatctgcccaatcatgctccatgtcatccattaaagaattaaagaagtctgctctttcaagcattttagggtcttgctcttttccctttggaggtacaaatctccagttgacttttctgacaaacatcttaataatatttacagatgctgctacagcagggtcacgcatcattaattggaaagttttaatactttcagggaaccttagtgcctgacgaggttcttcatagattcttccattcttaaccttcagacccaaagaacctacttcacccattctaaatggtggtaagctttcttgtgtttctgtaatatctgccattcttctcacctagctatcaacgtctaagcccctcatatgggtttcctctcactaagtctgtgtgagcacccattgatggtggcttgaataatttaacttcgttaagactgttgaaagcatcactggtagcatccacttggtcatctttagttttgccatcaccacaaaagccttcaagctcttggaaataagcttcgttccaactacctctcaaaacttttacaagtccagcttcagaagcagcagaaaatcccgcaaagcgggtaactttatctttatttgttggtttagctcttgcacgatagcctttctcggcaagtttcctgatgagggatgtcgcgtaggatttaccagcagcgcctgggtcttgagggataaaaataccagttcgcttaccgtcactttcagcagtcaaattaatttgtgtttcgactccagagggtctatctctaaatcttactacatcaatgatataatagcaaccgtcttttttagatttacccatcttaacacctgctgtccagtctggattagggttaatctcagatggtaaagttgctgctaagtcccatgctctaacatcaaatacatcttctgggagtgaatcaacaatttcacaccattgtctttgccaatagtttgaaccttctgcacgagccttccagttaccgaaacgaagtcttgcaacgttcacaggagtgttgttttcaagcttaccgcgatactttggttctaagaagtcaaggattgggttatcatcaatcgtaccagagataaaggtgtatgtttgaggaatctcaagagggaacatttcaagaatcttgtctctctcccaatcagaaaccatcacaccatcattcattacataccaacgaatacgaccacacttttcagggtctggataacctccttcatctaagaatggctctacccaatcataaataaagtggtctctgtctgggttcatggaaatcttcatgtatgaatcaccttcagcaccagaacgtagacgggtttgtaggtatgaaatctgtgaagcagagaagtgtgtaccttcgtcaaagtaaatagctgagtattcaataccctgatgaccttcagcgtgcttttcaagttctagataggtaaacttgatagtcgccccagaagggaatgtgatagtcattttctgctcgtgaggaatcccaccaaacttaccaaatagtttctttgcagcaggccataaaccaccttgtaactgtgttgtgtttcgacggaaatacacagcattatagttagggtcttcaataaatcttaaagagtccattaacaatgcagcagtcttaccagcaccagcagcaccaccatagagaaccaagtcagcattagtgtttaaaaagacctcttgagaacccggctgaggggctacatagttcttatcagtcatcaatttaaagataaggcgaacttggtctggtgtgtatcttaataaagtcagaatttgagttggaaggaatttagaggggtctttaccgaatgatttgataatttcttttacttcatcagaaagccccaactctccagctaggactttcctaacatcttccactcgcttctgcttaacagcatttaagtccattaagcgcctccgcaaatagaattattcagagtctgtcgcagtctcttctttcttaacttcgaactttgcatcaacagcatcaagaagtgcatccatagatgcttctttaatatcaatgcctgttgctacagataatctgtctgcaattgccatgatagtattctgcataaactctaacttcttgttagcttcataaagttctttataaacgttctcgctcattatgttttctccaaataataaatcttgtttccccttaaaaaagacggcacagagaccgtcaaggagaaaccacaatgtacgtcagagacatactgtataagtcttcctataaagtataactctgtaaaaaagccctgtctaaaaatactcttcggtagcgaaaggaagaatacttatagcagggcattattattattttaattgagagagagtaaaataacttggagaatccgaagggacttgaacccttataaacctgttttgcagacaggcacatatccatttctgtcacggattcagattggaggaagataccagacttgaactggtacaccgatttctcagctactggcagtttagcaaactgctcccttaccttttagggttaatcttccattatttctgtaatgcgttcttcatttctggtgttgcaatagtgtcgattacaccagttttgcgagcatcatcaaaccagtctggtaagatacctgctaagaacccattgatattcgttttaaggtactctgcaataagggcagcttcttcttcaatcatctgcacaacttcatctgcataagctgtaatctttgagataccttcattaatcttgctaacagcttgattagctaaatcagaaacagtatcaagacccttatcaatagcgtcttgtaagtcacttaacacaccgttaacactgtctagtgtgctgttaatcatgtcaatagctttttgaccatactctgtagcaacacccataataccactgaatggtgtacaaccaacttgttctcctgctgcacccataacattggaatacccctttgctacctgcatacgtgatgaaaactcatcaatagacttttgaccatagtctgttagggtcttagtagttgctgtagtgcttgtcaggcttgttgtaaagctgtttagaaggactgttgtaagtccagcagcaacaagtttctcattcattgtcgggtctgttacagagctaatagagcttacaagtgatgtagaggcagctacggttccaccgagaactgctgcaccagtaataagtgggttagaaaaccctttaccggtttttaagagattaaaaatctccttaccttgtcctgtcatctctttcattaagcacctttgaaattggtagtccagtgggatttgaaccctcttctcatgtttttcagacacgcgctttaaccatataagctacttggactataaattggggtgacctacgggatttgaacccgtatagaccatgttcacagcatgggtcattaccgtttatgataaggccacatttaaggactctcgtaagaacccttagaagtggcagcggcataaggatttgaaccttaataggacagcttcagagactgctgcattgccagttatgctataccgctaaaattggtactccatatcggattcgaaccgatacataacacagattttaagtctggcctctctgccaattggagtaatggagcattggcgggggatgttggaattgaaccaacttcttcgatttcaaagaccgaggttttaaccttgtaaactaatcccctttaaatctttactttctcagtggatgaataaagaatgccaacataactctttcccttgagaatgctctttcttctgggacaacactttttagtttccatccaacataaattctccagtaaaactgtttaccaaagactttaattgacggaataaaagcgaataatccccaagcattgttgttccacattaggagataaccagtctgattatcttcagggtcagaacttacgttgatattacctctccacttagtaacatcttttacatctcttcctaatacatggtaagagaagttataagctttgtttctccagagccacccaactctctgcatgtagacacccagcttaccaatctttctaatcttagcccatcttttaacgtgaccttcgtcaccatcaatcgggttgtcataggtctccatccatctgaatccaaaaggtagatgtcctttcttctcactgtagaatggaactacgaaaggtgctaagataactgctaggattgctgcaattgggtctagtaaagctaagaaaatccatgaagcatacttcaaatatctcattaaatagcctctttaaattggtgttccaagacggattcgaaccgtcactaatacaaggtttgagcttgcatcctctgccaattgggatactggaacatggtactcactaaaggacttgaacctttttcttcatcttgtaagggtgatgttttaccatataaactaagcgagtgtgaaagaggtctgaagttgtgccgctaactcaactccgtggaatttgttacggtcttcagttgacaccagcggtctttcacttgacctctgaattggtgctgctcacaggactcgaacctgcatttccatccttacaagggatgtgtaatagccaattatacgaaagcagcattgtttggagcatccagagggaatcgaaccctcaacctcagtttggaagactgtaattttcccgtttaaactatggatgcactaattggtggagtcactgagaattgaactcagttcccaagtttgcaaaactcgaattttaaccatataaactatgacccaaatgtctggtacaggtggagggaattgaacccatcgtcttactgattaagagtcagccgcataaccattttgctacacctgcattaatttggtaggagacaagggattcgaaccctcaaacaccaacttctaaggatggtaggtttaccaattaccgtcaatctcccattaaatctttttagagaacttctaagaacctaagcaacaaggttccacaacaagcggtaataaccttagaagccctctaaaaagacctaaaaaggtctttgcatagtcttgtttaatccggtgactagaacctttggagagcttgatattatctcttctccgtgacacctactaggtgttttatcagtgtgtacgacaatacacgagggataccaaagcaacatccgaatgaagcttggctttaaaatcttattaggcggtaagtaaaggagtcgaaccctcaccgtatctctacagtggcaactgttttcaagacagtttggctaccattagccgctacctacccataataagactttggcatgggacggaggagttgaacccctttgaaacggtgttggaagccgttgctcatgccttagagtcttaacatcgtcccatactataattcgaagcttaccgtattatctcaacactgtaaagccccttctcagattatttacatgttctggaaaacatgagatacagaccacctccctacaggaagacccgcttaggtcgtctaagtaatctgctaactaattggtcgaggcggcaggactcgaacccgcatactccacttactcggttaacggcggtttagaagaccgctgagatacgccccgtaattatctttaaagactctcttagaaagcccttaaagatgcccaccttattaatcataccgtgggctagtacgccaaattctttgatgagggattggaagacctcactggtgtttagcctatcaagctactgccagaaaaacattgtcgtttgcatttattttaaatttgcaaaatagacgctacgcaacgaaaactattacagaatatgtacaacaaatttccccacattgtgttacgtctaacgctcatgtattggtgtttgaattatacatattctgaagtattttagttactataaagtagtcacatctcaatgtcaacaactttattgaaattggttgtaggtgagggtatcgaaccctcttctaacggttatcagccgtttgcattaccatttatgctaacccacaattggaggttcagatgggaatcgaacccacattcataggcttatgagacccttgcattaccttatctgcgactgaaccatattggtagaagtggagggattcgaacccatcgcctgtcagattaaaagtctgccgcatcaccattctgctacacttccattaaattatctttgtagataagctacccagacttgcttaaggtctgtagcgatgtgcctttttgggtttaaatctagaatttaccctttcaccctttgtggtcgcatactcacaggtaagcttaataacttatctacaaagataattaccagaccgttgtttatcatcttaagtgctaccattacaccaactcgacacctgccgagtgaaggaatcgaaccttctccttttctttaccgagaaatagattgtttaagttttgctgtaaacggtcttctgtaaatttggaggcgggtgcaggagtcgaacctgccgataccatgctaatgagacatgtgagacgccctttctctatacccgcaattcttaatgaccagaccaaatctcttctttgtccgatttaccttcagatgaataagattaagtttgctgtaattggtcttctgtcaaaactggcgttccagaagggatttgaaccctcaaatatccactttgaaagagtggtgactataccattttgtctactggaacattaatttggtctctgttggaggacttgaacctccggccttaccgccccaaacggaacgctctaccaagctgagctaaacagagataaacttttcaaactctatgtaaccactttaacattattttttagtgattgtcaagaacttttttaaaatatttttcagtatcttagaaaagctctcgtttcgtttctatgtagaacatattaaagggtatcaaacacattgtcaataccctttttaaaactttaccagatataacggtcaatcattactgctttgagcattacgctgatagggtcaaacttctcaccaccaagcagagcttttaaagtggctggagagaaaccagataccattgctacaccgttatccttaacagatacttcgcaagtaccattacggtttgctaagtaccagaataccagttgtggcatttcgtatccagctttcttgtacttactctggattgcttcaaagtttgtgcgaccgttagctccatcaacctgattgaactccatatctgagaagatgataagcttacttggcatatctttctgagtcaagttatttcttttacctgtctcaagaatacggtcaaaagctgcttgtaagttagttgagccatattcaacgtgccgcatcacctgacgaagacggtttcgtaaatcaccactcagttcgatgaagtgagggtttgttgagtaaaccattaactcatttttaaagcaacctgtattgcgttctgctacatacaatgcaagtgatacaccaatatccagagcagtaatggagccaaaattcacccaagacattgaacatgaaacatcagacatacagagaatgttttcaccctctgccatccagtttggtagtgctttccactgctcattagcaacatctgcattaccatacttaacagacttaatcacatcgtatgggtaaacagcaccagcattaatcttagtctcaccctttgataaggactcgatgtaagctttgtagcgttctccatctttgcggttaaacagtttttggtaacgtgcagcagcaagtgaaggaatcttactgtagtcaatcttaccaaactcattagcagagattttttgctcaactgtatcagagagcgcagacaacagtgtgcgataatctttctcactcaagttggcaaacttacagaaacgttttacaaactgcttatgacgtggtttgactcgtggtaaccacttagctgccaaacctgctgttgcagggtctagtaatgctgcttctaaatgtttgaaggcatctgtctcgaaacgagtacctacgaagattttgaagtcatcaaaacgaccaagttctgcaatcttatccataatgcgaagaacctgtgtaggctctaaaactttatcttcaattgcttgaagcaaaacagttctgaaggctttacgctcacccataccttctcgtacatctcgcatatgcagtaaaatacgaactgcaacatcaacatcgtcacgcaaagctttgtagaacaggtctggtaagatttctacattgctacggctcgaaccagcagctttgtaaaagtctacaagagcagacattgatgaagtatggtttacagcaccattttcagttcgacctgcatgaaggtgcgcatgtttaaataattcgctcatattttactctcttctctcatttgttgtttgatgtgacagactttagagtaactttatagagtctgtcaacatcttttaaaattattttttgagggttgcaacagcagagaacgttggtttgttttctgtctgagactgaatactgttatcaggagtcttcttagtgtctgctgcaatggctttcatctcacctgctgagtgagtcatgatagttttaccgacctcaatcatgctcttgatggttacgtcgtctgtgtttaacccgaactctgcaagcttagcagcgtcccttgtaacaatcgcttcaaacaactttgcagcaaactcagcagaattatcaatggtcagttgagcttttacgagtgagcttttgttacgagagccttttggtcttccagatgggtttccagactggccttttttaaactggcctttgtttgttctgtttttcattggtatgcctcttataagacctcttaaaaggcttttaagataaaagatagatatccagaaagatatctgtttaaatagcctttttagaggaaccttttaagttatcttctaagtatttataagcctataccttgtcaagtactttgtcaacaacttttttaacttgcaatagttcttgacttgttgtatggattactgtaccatcttacttaaagctgtaggtctgccttgttctacaaaggagacttaatgagaaaatcaaataaaccgaagaaaggtaagaataccaatcactgtaaggaatcaaaaagggtagaattaatctactattcatcctctgaaattggtctgtacctgttctttcaaaattacagaagacaagaggattatctatgtgtagttcccaattagaaatcgcagatattatagatttatatcaaactgcaaagagtcatggctatataacctcaattggaaagaatagtcactatgatgctttgactggaatgtatttcagggcaatggctcaatctagtgaacaacacttagtggtttcttccagtgagtttacttcgtttctctattgcagcaaaattataaatcgcaggagaactgaaaaatgttaacagtaagttttaattacaatagtgatggctctgtatcaattaactcaccatatgcaaatgacctacttaaagagctagtcaatcagtgtgagaggggtcttcactatgttcaaaattcttttaaacagaagactattgctaataacttgatgcgtgtaacagtgacggcatcgaatccaaattatgactttgatagtgaaagtccgtactcattagttgcgcttggagagagcagccaattcaaacttgtttgccacgactcagaaacattccttaaggtattttccaaccttatccataataataagtacagctacgttgatggtagtgtaaacttctatccagcaaactatacatgtttgttaattgataatatgagaaaaagtaagcaagagcctacagaaatttcatttgatgtgaactctagtccagacgcagaaacaagtaagaactttgatatgagttacgcattgtcactcagtaagaaatccgagttcattgattatgtcaatggatttggttttaagtttgatgagagtatgaatcttaaaaaacttaagaacctacttaagaccaaagcttaagtgtgaataggggctgatgcccctttaactatttataaggatatttaatgaaagctaagagtgcaaaagacttttattgcttcctacaatcctatatcaattccgtgcaaaatggtgaaaggtacagccttaatgatgttatcccaacacctttgacatggagactcagcaaatggcctgaagaagatattacaccaacaatcgaacagcgtacctacaaacccgaaatcaatattccagactctgagaatctattatatccaatgttccatattgttggtcttggaagattccttatggatatccagtatgtaattggtaaaggttataaggttaaaggtattgttgttggtgacgtatctccgcatcacaaaggttattttagactaaacgcacatttagaggctaaaaagaaatgattaaagcaaagacttactcagacttcaaagagtttgtgaagggcttcattgcaaacgtaaaagctggtaagagatatgattttagaacatatcaagaggctattttaccgcttacctatagttcgtattggcctgaagctgatattgcagaagttgaggagtttgactacaaaccagactacaaagttccatttagtgatgagttgctttacagcatcggtgctcaaatgagaacttctgacttcttcatggacttacaatatgcaattatcaatggtaaagacgttgatacaatttattgtgaatggctggcaagggttaatccgttctcaatgttgaatgctaagttgaaggatgctatcaagccaccagcaatcactcagcagccaaccaatcaaacagtaaatgaaggtgacacacttaccctaagcgttattgcaaccaatgccactggatatcagtggaaaaagggtggtgaggatatcactagtgccacatctgcaacctacacaaaacagtctgtagcaccttctgatgctggctcctatacttgtgttgtatctggagaggctgggacaagtgttacctcagatgcggcaacagttactgtcaacgcactgcctgtgattacacagcaaccttctagccagaccatcaatgagggtggaagcattaacttggaagtgactgcaacaggtgcgacaggttaccagtggaagaaaggggaggaagacatcctcgatgcaactactgcaacttacaccaaagaaggtgcaaccactgctgatgcaggaagctacacctgtgtagttactggtgcaggtggctctgtaacatctaacgcagcaacagttactgttaacccagcaggggaggcataatgcaactctcaagaaaaggtttagaagctattaagttctttgaaggtcttaagctagaggcttacgaagattctgccggaatcccaacaatcgggtatggtacaatccgtattgacggaaaacctgttaagatgggtatgaaaattacggctgaacaagctgaacagtatcttctcgcagatgttgagaagttcgttgcagcggtgaacaaagccatcaaggttccaacttctcagaacgagttcgatgcacttgtaagtgaaacatacaacatcggtatcacagctatgcaggattctacatttatcaagcgccacaacgctggtaataaggtaggttgtgcagaagctatgcagtggtggaacaaggttacagtcaaaggtaagaaggtcacttcaaacggcctgaaaaacagacgtagaatggaagctgacatttatcttgacagtgtatatccaaagtaatatcttcataggctccttcgggagccttttttattttctaaggagaaaactatgaaactttgggctagtgactttggaacttttaaatacactcgtaatggttctcttgtacgcattgtaggaaacaatgttgtttcaagaggcgacaatgtgtatacacggtttactgtagaacttgttgaactgtcacctattgagtctgtgaacaatggcctgttcaagtttgagacttacaatgtcaacgaacatggacaattcaaccctcttggtgaaagtggacttgatattatttcagagcacccattgacaaaagagcaacttgcaggttactataaatctgttctggaaaggcagttagcaacacatgaacaagaagctaactaccatttacagcattgcgaaactttaagagcaaaaatcgaacaagcagagagaggtttttatgaataatatcagtcagattaaagttaaagtcgatgttagccgttacagtggagatgaagaattagacctgcgagatgcgattctctatgagaagaatggtaacctgcatttacattttgaaggtacaaacacatatctacacagatgtcgagatgatgtagatggttgtcctgtttttgcttggtataatttagagttacctctttatgcaatccactacccagatggtggggaagactggactactcaatcaatctttgatgaacttaacggtattccagttgagcaagaagagcaagaacccgttgaacttaccttcacttttatcaaagaagagaaagtaggtgacttgtcagtaaccgaagcaattcaagtctcacaggttattcgttaatgagtaaagtacaggttgttttccctatttgtgacttctcactagagcgtgaacttgacctgtacgaagaaattactgacgaaattatctggtctgttgtagaagaggctatcaagaaactgtatggtggcctcttaaacccatcaagtaaaaagctcaatactaaacaagtagctgatacacacacttcctatgatgcctacaacaaaccttttgagaatacctgctttgaccttatggtaggcaataacaaagtcaactatttcttcgtcagagagtttaacgatgagtaagctccatgtcacagtgtacaaaaacttctcagatattaaagagtctttaacaaataagcttgacttacaacgtaaaaggctctttttaatgtatgacatagacaactacaaccatcctaaagagtttaactacaaagatggtacgaaggtcgttgaatttgaagattctgtgacggtgtatgtcaaatatgacttaccagcaaagtacatagggatgttagagtattacatattcaaacatacaggtatgcgtggtgaagctgtcaagatatcttctatagaagtttttgagaaacctaacacacaacttaaaaaatatttaatgaggaaactgtaatgtccgaagagcaacaggatatcattccacaagtaacacttgtacaacactttggaaatattgaagggtgtgttgcactttttcaaccaagcatcaactctcctgcaaaagtttgcaagctgactatgaatgttaacaacatcagtgtttgccttgttgatgaagttcaatatttcaagttcaatgacagagaggttgatgctgcactattgaagtatcgagcaaacctcgaaaaagatattgaccacaaagaacttgtaacactatttggtgaccttcacaagcttcttgaaaaggttattaagcgtacatactacatgaacaatggttcaattattaccactttgatttcaccatgtatttcagagccaattttaactgatgatggtggctactacgtggtagcatcagcagattctgattggtggatgaagaacacagcacttaaaacagtgattgaggctatccgtgagcatatcccttcatttagcccgtggaaaggtaaaagtgatgatttcattgcactattgagtgaagagagtagcaagcgcagtgcattactgcctaaaaaatactcttgaccaattatacaaaactgattatgatgggagctatcgagaggtagttccctttttagtttctggagagtagatatggctaaagtgaaagaacacgataaaattattttgtatgttaaacagaatccttcaaagagtgttgaggctgttgtaacacatatctcacacaacggtacagtttatttccgaccactgaagaacttagactttgacacaacaccaaaccacacattcagtacttctgcaagactgtgtgcagggactgtatactcaactgctgagattgagtccttatctttcacaggtgcttacaaaaactttatagggattgctctaaaggactctgaagagtcttttaaatttttcatggatgctgctaagggcggtcatacacatattatgccagtctttaagaaagttgatacagaacttaccagtaagtgtgaagagattagtagtgacctgaaggagcgtaaaacagctattcagaatgccatttacatcattgagaggaatcatttagaagttcttttcagagatatgctaaaagcagggtttactccaaacgaaattacaagagaaacacaacgccagttcagaaacgctatggtgaaagaatgaaaaaactaactacagttgaagactactacaaactttccctgttagaacagtatcgcagaagccagaatatcagaaaatgctatggtaagcacgctgaaggtgatttttaccattgctatgatgcagatttaaaaggcgtaacacctagagggaaagttctgcaaagatttgttgaccttgaatggaacaaacgattgagaggggttggaaaatgatttacgaagaaagatacaagatagattttcaggatactcgccatcacacttctttaagagtgacgaaaccaaatggagataccggtatcatagcacattttggtggtgattactggtatggcacaggttgctttgaaggctacactcaagaatacctgaaagctttctacagagactttgcaaatgactacaacagagttgttgacgaaaagaataagtgcattaagcatgaacaccatgccagaggctgcctaagtattgttatgggactggcattcttcttagcaacgttactggcagtatcagtaatcagctacacagctcaagatttgacaattacacagattactacaaagatacacgatatctggtacttgtatgctgttcctttagctggtatcatcatctcactaatgaggttcagagttcataagaaacgacttaaggactctgaggttaaacttgaagaggtaagtaaagaatgcaacctacaattatagctgtatgtgttcgttttgcaatcgctgaaatgattaacaaggcaatcttaaaagatgcctatggagagactaagtaatgattaagacacctgtaccaatttttggatttccttctatagaagagttcaaagtttatcttgacaaaaacttctacaatgagcagcctgttactttgctgaagagtgacttatcagagcttcttgatatggttatcaaggcaactcctgagaaggagcctgaacagaaagctgagaagaagactagtaagaaatccgataagaagactgaaaagtctgagtaataacttaggggttacttgatagcccctttgtagaaacttagaaggtagcgaatatgaaaattaaaaaagtcgttcaaaaagcaatgcttgacaactcaactaaagataaaatgtacaaagagatttgtgataagttgaattgttcaagacatgctgctaaggctcttgtgcattgctttatcttggaatgctcagaagcttatatgaaacatatagcttttgaaagttctaacttactaggtgatgtagaagttggtgagaagctaaaagaacctgagatgaaaacagttcctaaagttggtaatacataccctcttaaagatttcaagactggaaagattgttgcaaaaggtgtagtagaatctgtctatcatgatggtaaatacttacttaaaatatttgagtatgatagccgctatacacacttgtgtggtcttacatttttagtaacagaagaagacctcattaagaacaatgacaacaagtttgcagtaccagattaccaagttttacgataatggtgtgatagctatggaaaaagataacttaaaagaagttgaaggtaactacctagtccttgactggaatgatgttcgagaagcattatccaaagaaagccttgacatactagagcagcttgtcttctcagtacggcatatcagagaagttaagaatggtaaagagccacttgaaggaatctttgtagagaagtcttatccgttctatgaagacactttacagaaagttaaaatgtactttaaacagaagaaccgtaaagtggtcactatggtatctcttggtggacagagtatgtctgtgatggaagatatcaaccctaagagaccaagtaaaggtgtctgtataaaaatcacaggtcatgaagagtatatctcagtggatgattttagtgtgttctgtaatggttctgctgtctttaatgggtttcactatgatatccgagtgtacccaatcaagggagatgatatcatgatgcagatatttgataacaacaatggattcactcatttttatcagacaaccaagtcatcattaaaaacagttctggaaacactgatttaaaatatcttaagagcctccttaattgggggctttttatttttataaaattttatcggttgtcccaacctctgggtcaccatcatatgtgaacaaaatatctatccttcttaacaaccttcttaatcttactctctatatagttatatagtactatatagtatcttagtaactatctagtggtcttaatagccctctgtataacccttctaactagccctctaacaagccttctaaacactcttctaacaagccttcttaacaacctatacaatcaccttaaccacctctctataccctcttagaagctcctatacacctcttaatctctgggttatctatgataccctctataggtgttcactcggtattactaagcttctatatagtactgttttaacaaacttaacagggatatctttacagaccttatctcacaaggtctaacacggtactaacaaggtatcttataagcctgtttctacctgtatttttaaaagactgtataggtaattattcagaattttaaaatttttataaaataggactatcaagtcatttttagggtctttgaaggaactgaaaaatatctgattaggatgtatatctgcttggtagcccttaacagccccttaacaccccctttgcagaattttaaaatatccttaacaatctcttaacagttctcacatcttcttaacaactctttaaaggtcttaacagtttcttaacagaactaacaaggctgtaacagttttctaacaagtgctgaataggctttacagatgcttaacagatgactaacaagttaattttaaagagttattttgttaagataattaacaagttcctaacaagtgtttaatctttttaacaagctattaacatgacaactcttctttcttatcgttccctttcctttcttagtgattccttaaacatacctcttaaaagctctctatagctctttataggctcttttaagtctctccctagtatttacccctcaactgtatggatagctctttatagggctttacaggagcttttaaggctatgccaaagactcttacaaggcttttacgtggtcttaacagagatttaacaaggggctaacaagttgctaacaagtgccttaaaagcataactatgtagggtttgttaagaaattgttaagaaaatgttaagggggctagctatttacgtaactttatagctctttttacgtaactttatagctctttttacgtaactttatagctctttttacgtaacttttaagctatctctgacgtaacttttaagtgactttgtagccctgtttagatattcacaagatactagccagcttataagcttatacccttataagattcttttaaggctgtaggaagctctataaagggtttttaagagtggtttaatatgattgcttaagttgagatgataagccgttatagagcgttatagagcgttatagagcgttttagggattgcccttcctttcgggttatgggcttatatttaaggggaagattagttgatttgataagatggtatagagtaaactatagagttattactctaaatgtctggtaagattctagtaaggggttgtatagacgtaaaagcccctttctaggggctgtaaaggtatctgggggctatttgccccgttgcggcgtcttgttaatcaaataactttcttgtaagagttgccagaaatgatgtaattagtaactgagtggtttaataaatctgtaccagtgatgacgaccatttcttcatttttcttttcttcatgctcttttttcatttcttcccaacgtttagcaccaaattttgtaatcatacgctgttcaaaattcatttttcaagtctccagtttaggattgttggggaggtcattccctccccttgttagatactttaaagactcactagtgtttcatcaagtgaattttctaagttttttagagattgctcataaagccgaattgctctactcaatgcctcgcctaacgttattttgaatttagttgtcggataatcacttgtaaagatattttcaacatcatagagcgggtattgttggttacccgtccccatagcatacatcccggtataatggattgcaataaaaagattatgagacttgatagaacgctcatatgccattttatagcggtttaactcgtttttagtggccttgatagccatttcgtgaatctctgcgacgatagccatataatccgttaaaatcattgcaacagctttcataaagttgttagcggttaccattttctgatttgggcgatggatgtaatactttttatcttcccctttcgtgatgactgcaaaagtcttttctttcagggtaaactcaaaggtatccttaacaggttttttcattacatcttttgagcggatagtattaatagcggtgaacttgttcattttgaatctccagtttaggaagtaagcttgattgcttgattgatactatagggcttttagaaagtgattgcaagccctttttagtcttatctataaagaatcttttaagtgaatcccttttagataaaaccccctcgaacaaatgtactattgtcaaggggtatcgtcaagtaatttttgaaagttttttgtagttgttgattagcttataaagattttttcaggctttacgtagctgatacgttgactttttagcaggtcatcccagattagagcggcaatatgagagtaaccggattcacgtaagagcttcattgtcttactcctcgtttcaaaacggcttgcgtagtactcgctatttaaggtcgttttattcccttcgttatctacatggataacctgcatcacttgaaaggggcttgtatcctcacctttgttccactgttcaaagtattttaggcactgcataggtgacatcttatcacttacttgagttgaccaagatgcgccagctttatcagtaattacggttacataagccatttttagaatctcctagtttaaggtctttacttagtggggaaggtcattccctccccgttgattgacaatttacagacttttatcaggcttgtctagtctttttcaatgataatttcatattgaccatcaacactgtcgaaatagattccgtcgtcatcttctgtcttaaagtaacactgaatatcatcacttgcgggatagtcttgccttgctatctggcaaacttgaatagcattttctttacttcctgtgaactcctcaagccctttaaaatcacatgaatggccattgcaaatagaaaggataaggtaaacggttgtaagcatgatttaagccctctaaatggccctgtatgggccttaagttggaaattagtgtctttgtactgcttagtctaaaaagtcgcttagattgcgctctgtgagattctcggtaattttatccagcaggtcacaaaacacagaagaagtgtccccgctattctgtacaatttttgcaatactcaacaaatcatcgtcaatatagcccaaattgcggttagttgtatcaggtacaaagaatggcgcatacatcgcactaaatttcgtcgagtgaataccgataatccaatctttatcaaagtaaccggtaaagctggcgatttcgctcatgttgtcacaagaataatcgtcctcaagttcttcctctgggatatccatttcaattacaatcacttcctgcgtttccatttggaaagctgccgtaataagccccgactctaaagcgttttgaatgcagcgttcacggatgtaagaggcttcttcatcttccaggcattccatcttgataatcttatccatcgggtaaacgtaaaaacaatcatccatgtaagagcagttccagataccttccggcttgtcgccacctttaagcaggtttacaaagtttttcatagtagttccgtgatagcatttcatttttgaatctcctagtttaaggattgagtgataaagctctttatctggggcttaagatatcaacttccaagccccctgtaaagtactttatttgttatttttgacaacttttaaaactgcaagataacctaagcaataagaatcaccgaagagagtcctacccatgaaagaatcctctttgatatcctttgcagtgacagttttctctacgccgtgggaaaggactacatcaccaactttaatatctttgatgtgagttgtttcaatgtgtaagccgttgataatagccatttttagaatctccagtttaggactttacttagtggggaaggtcattccctccccgttgatgtgtaatttaatctatctaaaaaccagtgtcaacaaaattttttagagttctgcataaattgcatcgcagataccacgaaaatcgtgatttgtcaaattacgttgtaaccaagtggcaaagaaatcagcgattgcaaaattagcgtcatactcgacagatagccacactttgacagcaaatcgaaacattttcaagtctaattctttattcattacctttgatttgcctaacatgtcggacatttcatattgtgcgccgtctagcgtgatacctgctgcaacgtcagccaatgaactttttacattttcaacgtctaagataacactttgaatcttcccaataatgttatgcaatgtttcatccggtgctgatgacgtaataacattaatccggttaacggtcaaacgtgcttttaagattgctaattcacggttattaatagccatttttaagttctccaatttaggatttagtggtaaagctctttatctggggcttactttacagacttttaagccccatgtaaagcactttatactaaatgcagctttttaccttttactatgatgtaacttgatgcactattactacatacatcttgataaattctgcgcaaacgtccttcgtagtgtactttccaactggttggaatctttttaccgtatcccgtagcagttttttggagtcctgctacttgccaatctaagatatgttgttcagcccgtaaatcctcaaagtgcattacaccgtctacatagtgacgtaaagttacatttaaagtacgaccattgttagtagtatacattttagactctcctagtttaaggactttatttagtggggaaggtcattccctccccgttgatgtgtaatttaatctatctaaaaaccagtgtcaaacactttgttttcgtttgctcaattcttgaacaattacagcgtagtagtcttttaagtcactgatatttaaagcatttatcagtgaattataatcatcgactaactgaaaatcatctttgaagatgtcacttatctgataggttttcgctttatatctgaagctcatctctagccgctttatttgctcatcactgaggcgctctagaaagctctctacaaggctattgctaacctgctgcgtgattgccttatttgctagattatagctttatatgccttatagagcgcgaaaatggcaatgattgcagtgataccagtcatcagcatggtgtttcctctttacgtgacactttaccatttacagatatctcataggattctaataaatcgcttttagactttacaggacttttaaaagtgtcatcataaatattgacttgcaatacaggttttttatactccctgcaactattccataagcaaatcactacacgacggccttttatttttccatgtaaccattccataacatcatgattattccttgatgtttcaatgaaatcaattttgtttagtaacttgtcttagattttcacgaactttatttgataatttcattttgaatctccagtttaggacagttgataaatctctttatctggggctatcttatcagcttgataaccccgtgtaaagaaatctctttagttcttaaagatattcatcactgagtcttttaatgattccaaacgttctaatacttcagtttctgcgtctgaattgctcacctcttcttttagtctttcctctaaatcatcaccgtcactatagcaccagtcaaaggcatatcctagataaaaactctctaaaaccgtgttgccatttgcatcgacaactttcgcggcaaggtcgtattctgaagcctctaaatctctttctaattctttctgtaagctaatgtaagcatcttttgatggattttcccggccttgttttgcatagtcacttgaaagctgtttaaggctgtaatgcaaagggattgcatatttaaattcattatactgacagttaggatttttaacagtcacgccgcttgatggtcatctgtaaacttccaattatcaagattatggcttgcttcatagcaatttaccgcttcgtagatgatggaaaatttttcttttacaacttcaaaggtagcgtctacatttttcattttgaatctccaatttaggatttagtggtaaagctctttatctggggcttaagatatcaacttttaagccccctgtaaagtactttatcagttaatttttagctttgcatagcttctcattgtacgaatgggagatgttaaggctacgcgtctaatatatgcctttttcgtgtatacatttgtcttcccgatagtgtttacacatgtaaaaaggtttattggtgaattttttaacttcaactgtttatcaaccttcacgccccaccttacagcagattgtttcccattgtcaaccactttcccgcctaactttttcgccatgatgcgagcgtcatcacgagtttttgcaggaattacaacgtttttgataatagccattttttgaatctccaatttaggatttagtggtaaagctctttatctggggcttactttattgaactataagccccctgtaaagtactttattatctaattttgaaagttgttacataaccatcactaccaatgatttgcggcgctccaactttttctactgaatagcccatattttcaagatggtaaatagcatcatcacaaccatatgcacctccctgataacgtctcttatcacatcttatcaggttttttccacgtcctgcaagtgcatgtagaatggctttttcacttgaaagcgcaccatctaacatggttgccgtgtaatggttgattttattcccgttaatatcatacttaaaattatatgcgtgaacaacaataatatgacctgtaaaattctcatcaagtgatttttccagtgcattgcggaaattgcctttattgatgaatttaggtgcacgatatgccattttcagattctcctagtttaagggttttatttagtggggaagtcatttcctccccgttgatgcaaatactataaaaacccgttcgaatagtcaagaaaaattttaaaaatatttttggcaaaaatgtaatgaaacgggtgcgcgcgaataccacaaaacagaactataatcaagaattatttttcaatccgctacaaatttttctgttgacttttattttcagatgtggtagccttgtgagaaatggcgacagcccacctacaccacctacctgcacaattctaaaatgatttttcttgcccgacctgattttttctctgcacgtttttgaaaatgaaaaaagtcctttgga

SEQ ID NO: 6 - DNA, 86887 bp, Artificial Sequence
  Bacteriophage San 24
tctttttacgtaactttatagctctttttacgtaactttatagctctttttacgtaactttatagctctttttacgtaactttatagctctttttacgtaactttatagctctttttacgtaacttttaagctatctctgacgtaacttttaagtgactttgtagccctgtttagatattcacaagatactagccagcttataagcttatacccttataagattcttttaaggctgtaggaagctctataaagggtttttaagagtggtttaatatgattgcttaagttgagatgataagccgttatagagcgttatagagcgttatagagcgttttagggattgcccttccctttcgggttatgggcttatatttaaggggaagattagttgatttgataagatggtatagagtaaactatagagttattactctaaatgtctggtaagattctagtaaggggttgtatagacgtaaaagcccctttctaggggctgtaaaggtatctgggggctatttgccccgttgcggcgtcttgttaatcaaataactttcttgtaagagttgccagaaatgatgtaattagtaactgagtggtttaataaatctgtaccagtgatgacgaccatttcttcatttttcttttcttcatgctcttttttcatttcttcccaacgtttagcaccaaattttgtaatcatacgctgttcaaaattcatttttcaagtctccagtttaggattgttggggaggtcattccctccccttgttagatactttaaagactcactagtgtttcatcaagtgaattttctaagttttttagagattgctcataaagccgaattgctctactcaatgcctcgcctaacgttattttgaatttagttgtcggataatcacttgtaaagatattttcaacatcatagagcgggtattgttggttacccgtccccatagcatacatcccggtataatggattgcaataaaaagattatgagacttgatagaacgctcatatgccattttatagcggtttaactcgtttttagtggccttgatagccatttcgtgaatctctgcgacgatagccatataatccgttaaaatcattgcaacagctttcataaagttgttagcggttaccattttctgatttgggcgatggatgtaatactttttatcttcccctttcgtgatgactgcaaaagtcttttctttcagggtaaactcaaaggtatccttaacaggttttttcattacatcttttgagcggatagtattaatagcggtgaacttgttcattttgaatctccagtttaggaagtaagcttgattgcttgattgatactatagggcttttagaaagtgattgcaagccctttttagtcttatctataaagaatcttttaagtgaatcccttttagataaaaccccctcgaacaaatgtactattgtcaaggggtatcgtcaagtaatttttgaaagttttttgtaagttgttgattagcttataaagattttttcaggctttacgtagctgatacgttgactttttagcaggtcatcccagattagagcggcaatatgagagtaaccggattcacgtaagagcttcattgtcttactcctcgtttcaaaacggcttgcgtagtactcgctatttaaggtcgttttattcccttcgttatctacatggataacctgcatcacttgaaaggggcttgtatcctcacctttgttccactgttcaaagtattttaggcactgcataggtgacatcttatcacttacttgagttgaccaagatgcgccagctttatcagtaattacggttacataagccatttttagaatctcctagtttaaggactttacttagtggggaaggtcattccctccccgttgattgacaatttacagacttttatcaggcttgtctagtctttttcaatgataatttcatattgaccatcaacactgtcgaaatagattccgtcgtcatcttctgtcttaaagtaacactgaatatcatcacttgcgggatagtcttgccttgctatctggcaaacttgaatagcattttctttacttcctgtgaactcctcaagccctttaaaatcacatgaatggccattgcaaatagaaaggataaggtaaacggttgtaagcatgatttaagccctctaaatggccctgtatgggccttaagttggaaattagtgtctttgtactgcttagtctaaaaagtcgcttagattgcgctctgtgagattctcggtaattttatccagcaggtcacaaaacacagaagaagtgtccccgctattctgtacaatttttgcaatactcaacaaatcatcgtcaatatagcccaaattgcggttagttgtatcaggtacaaagaatggcgcatacatcgcactaaatttcgtcgagtgaataccgataatccaatctttatcaaagtaaccggtaaagctggcgatttcgctcatgttgtcacaagaataatcgtcctcaagttcttcctctgggatatccatttcaattacaatcacttcctgcgtttccatttggaaagctgccgtaataagccccgactctaaagcgttttgaatgcagcgttcacggatgtaagaggcttcttcatcttccaggcattccatcttgataatcttatccatcgggtaaacgtaaaaacaatcatccatgtaagagcagttccagataccttccggcttgtcgccacctttaagcaggtttacaaagtttttcatagtagttccgtgatagcatttcatttttgaatctcctagtttaaggattgagtgataaagctctttatctggggcttaagatatcaacttccaagccccctgtaaagtactttatttgttatttttgacaacttttaaaactgcaagataacctaagcaataagaatcaccgaagagagtcctacccatgaaagaatcctctttgatatcctttgcagtgacagttttctctacgccgtgggaaaggactacatcaccaactttaatatctttgatgtgagttgtttcaatgtgtaagccgttgataatagccatttttagaatctccagtttaggactttacttagtggggaaggtcattccctccccgttgatgtgtaatttaatctatctaaaaaccagtgtcaacaaaattttttagagttctgcataaattgcatcgcagataccacgaaaatcgtgatttgtcaaattacgttgtaaccaagtggcaaagaaatcagcgattgcaaaattagcgtcatactcgacagatagccacactttgacagcaaatcgaaacattttcaagtctaattctttattcattacctttgatttgcctaacatgtcggacatttcatattgtgcgccgtctagcgtgatacctgctgcaacgtcagccaatgaactttttacattttcaacgtctaagataacactttgaatcttcccaataatgttatgcaatgtttcatccggtgctgatgacgtaataacattaatccggttaacggtcaaacgtgcttttaagattgctaattcacggttattaatagccatttttaagttctccaatttaggatttagtggtaaagctctttatctggggcttactttacagacttttaagccccatgtaaagcactttatactaaatgcagctttttaccttttactatgatgtaacttgatgcactattactacatacatcttgataaattctgcgcaaacgtccttcgtagtgtactttccaactggttggaatctttttaccgtatcccgtagcagttttttggagtcctgctacttgccaatctaagatatgttgttcagcccgtaaatcctcaaagtgcattacaccgtctacatagtgacgtaaagttacatttaaagtacgaccattgttagtagtatacattttagactctcctagtttaaggactttatttagtggggaaggtcattccctccccgttgatgtgtaatttaatctatctaaaaaccagtgtcaaacactttgttttcgtttgctcaattcttgaacaattacagcgtagtagtcttttaagtcactgatatttaaagcatttatcagtgaattataatcatcgactaactgaaaatcatctttgaagatgtcacttatctgataggttttcgctttatatctgaagctcatctctagccgctttatttgctcatcactgaggcgctctagaaagctctctacaaggctattgctaacctgctgcgtgattgccttatttgctagattataggctttatatgccttatagagcgcgaaaatggcaatgattgcagtgataccagtcatcagcatggtgtttcctctttacgtgacactttaccatttacagatatctcataggattctaataaatcgcttttagactttacaggacttttaaaagtgtcatcataaatattgacttgcaatacaggttttttatactccctgcaactattccataagcaaatcactacacgacggccttttatttttccatgtaaccattccataacatcatgattattccttgatgtttcaatgaaatcaattttgtttagtaacttgcttagattttcacgaactttatttgataatttcattttgaatctccagtttaggacagttgataaatctctttatctggggctatcttatcagcttgataaccccgtgtaaagaaatctctttagttcttaaagatattcatcactgagtcttttaatgattccaaacgttctaatacttcagtttctgcgtctgaattgctcacctcttcttttagtctttcctctaaatcatcaccgtcactatagcaccagtcaaaggcatatcctagataaaaactctctaaaaccgtgttgccatttgcatcgacaactttcgcggcaaggtcgtattctgaagcctctaaatctctttctaattctttctgtaagctaatgtaagcatcttttgatggattttcccggccttgttttgcatagtcacttgaaagctgtttaaggctgtaatgcaaagggattgcatatttaaattcattatactgacagttaggatttttaacagtcacgccgccttgatggtcatctgtaaacttccaattatcaagattatggcttgcttcatagcaatttaccgcttcgtagatgatggaaaatttttcttttacaacttcaaaggtagcgtctacatttttcattttgaatctccaatttaggatttagtggtaaagctctttatctggggcttaagatatcaacttttaagccccctgtaaagtactttatcagttaatttttagctttgcatagcttctcattgtacgaatgggagatgttaaggctacgcgtctaatatatgcctttttcgtgtatacatttgtcttcccgatagtgtttacacatgtaaaaaggtttattggtgaattttttaacttcaactgtttatcaaccttcacgccccaccttacagcagattgtttcccattgtcaaccactttcccgcctaactttttcgccatgatgcgagcgtcatcacgagtttttgcaggaattacaacgtttttgataatagccattttttgaatctccaatttaggatttagtggtaaagctctttatctggggcttactttattgaactataagccccctgtaaagtactttattatctaattttgaaagttgttacataaccatcactaccaatgatttgcggcgctccaactttttctactgaatagcccatattttcaagatggtaaatagcatcatcacaaccatatgcacctccctgataacgtctcttatcacatcttatcaggttttttccacgtcctgcaagtgcatgtagaatggctttttcacttgaaagcgcaccatctaacatggttgccgtgtaatggttgattttattcccgttaatatcatacttaaaattatatgcgtgaacaacaataatatgacctgtaaaattctcatcaagtgatttttccagtgcattgcggaaattgcctttattgatgaatttaggtgcacgatatgccattttcagattctcctagtttaagggttttatttagtggggaagtcatttcctccccgttgatgcaaatactataaaaacccgttcgaatagtcaagaaaaattttaaaaatatttttggcaaaaatgtaatgaaacgggtgcgcgcgaataccacaaaacagaactataatcaagaattatttttcaatccgctacaaatttttctgttgacttttattttcagatgtggtagccttgtgagaaatggcgacagccccacctacacccacctacctgcacaattctaaaatgatttttcttgcccgacctgatttttctctgcacgttttgaaaatgaaaaagtcctttggagattatctgcacagtttgaaaatgaattttctctttggagttcagaattctctctacagatttctctacagaactctacctgcacaattctgaaatggaaaagccctccttacctgaaaaatttaccagataagaaaggcttagtctattgtgaatactctacagagtttcttagttctttgcgtctaagaaggtaagctctggtgaagagaagattaactcgatatcctcatcagttcttgcatagatataagtatctgcatcactgccaaatgttactgcaattctgtgattgctcttcgacaggtgggtaactagagcgttacttagagacatcttttcaaccggagggttactttgatgtatcttaccttttcttcgtctgaagagggtaactgtattgtccgtgaacacaactacacctgcaaagtattctggttcacagtagtttttccaacctgagtgtaactcgttgtacatctctgtctcgtagacatacagataaacatctacgctcttcataacctgattgatgataactgtgacagcttgagggtcaagtccaccgatacctgcaccaatcataggtagaccaaccttcttcaactggttgacttcacagtatctgttaagctgtttcaaagatgactctaaagcactgtatcgggcatctttaccagtatgaagttgggtgtaaaggttagctatacggccttgttttaaacgtactacagagaaattacctagtaaattttcacagggtttgtgacggatgccacctgcaaacaggtaaacttctgtgtcagtatcatacacttttggataacgcttagaaatagttgctgcaatacctgcacccatgaaattcatacagttgcaaccatgaccaatgatatcaaacttacctttatcaaatgcgtcaaagatatcacctttgataatttttacaatacccatttaacatctctcccaagattctttatcttcggaaggctttacacgttgtccttcgtggtctacccagatgcacccacagccttcacagattactggcattgcatagccagctttaaagtcatcttcagtgataagaccttttaagtcacctgtatcacgtccgaacatttcgatagaacagtctttgcagaagtcagccatataatatataccttatagttcagtttctcgtaattctttaccttcatcatagaagcatttatagaatgtatctatagaaattctggcaaaggtaaggtcttcaaagtattcttctggagttatccatgtaaaactaaaactatcgagattgtaaaatggtatcactgtgtcgttactaacgaaaacacatgctgatgtaacttctccagtgtctttatcaattacctctagagctttcatagtttaccatctcagttagctcatataaatcaacatgctcaatactgtcaatgttgacaccaatctttttgaaacgctccatcacttcgttatcagtcatccatatcagacaccaatgattctggatggattcttcaagaaggtcaacacaatctttaaaggtttttgtatcacttcttgttcctactactgcgattgttccatatagccacttaccattgccataagatacttgtgctacgccaacttctttacctttctcatagtaaacggctacaaattctcttccattaatctgcatagttacttcctcgttttaagaactgctaagatttctttagagtctggtaagaaccatgtgtagtgattctctttgatttctggatgagtgtcaacctttattttgcactctttaccaacatacttaagctgtgctgtgacaccttgcataaagatatgacacataacattatccataatggttggtaagaaatcaattcgcatataagtttcttttggtcgtggcaacagtaagtacccttctacgtaaaaagtatcttcattctctgtcattgctgcttattccctaataaaatcatatcaataaggttattagctttgattgtacactggtaaaagccgtcacgatagaactcaagggctgctgctacatcactgcctgtgttgcctttgatgatataccgtgactcttcttgagtgtacttatcgctctcacttacttgggagtttttgaatgtactgttcactttgttcgttgaacaccctgacatagttatcagtaacacaaacattataaaactctggcttagttttttcatatgttagtacctcttttgtatgcttattcttagcaagcacatctttcaaatcatttttgtaattggtgctcagtgtgactaatccttcctgataagcatctttagcaacacttatgagcttttgattgtttagctcagtttcagcaacttgatagtctctgtaagagtatcctccccagacacctgccccaactaagaaaacaattatgaaagtagcttgacagaactctttaaatgtcatttaacaatctcctgaaatgaaaaaggctcccgaaggagcctgtatcttaaccttaaccgaggactttagcaaggacatttgcagccatcgaagaagcttttgcagcagcagctaccccagctttgacagtgctatccttgatagcagataccgttgcagcatcagtaaagagataagtagttgttttagaaccacttgtaaaggaaagcatgagagcagtttccagattgaaagagcgatacggagcaccttctttaacgataccttcagcacctaattctgaagccatccccatatcatagatggtcatcaggttttctttgtgtgcagtcgttgaaccagcacctttgacgtgtttcttaacattcaaaagggcacgatactcccgaatgttaccgtctgcttttacattgacagcacggaagattttaccctcaaagttgctcttgataatgttacgaactacttcagatttgtttgccgtaacgtccagtgctaccgtaatgatattgttcataagttttctctcaatgtttaactaacatggttttgatgtgtggaaggattctgttcaccttctgcacattcttctctgtgtcttctataaaacatactatattaaagtaaggcagaatgcaagactgaatcatcctcactttcaaactttctgcacttatagagttagtcccaaaaccacgcataaaaagcatgtagtcatgctccgtgttatgccttaaaaacatctcagtgggtattctctgagattcacctctcgctgtcaagagtccaacggcagcatgattagcaattgcatcaatgatattgaaaacatacgttggttttgctcttacagaatcaagaagattagtgtactgtgaaaatgaaccatcagtcaattccgttgaacaatcttcgtgattaaaatttgtaagaactccatcaatatctgctaagataagattacctttctctacaaggtctttgttgactatgactaagctatcacgttttacacctatggattgcccagtctctttgtccacaacgttcacaattggttctgatgtgtggaactcttcaagtgagcatacaacttctcttgcggtgtcttcaaaatccctgcactgttctggagtccatacacaggaatcaagtcctaactcatgaggctgtaagtcataagcatggcacaatacttcatcagactttcttaattttttcatggtttaccttagaaatgtttgttgcaaattcacattgagcaattactttcatattgttataaacatcttgagaatatttcttagctttagggattctgtacgaatacccagcattatatgatgctaaaactttttgtaaagtcttctttgactttggctgaccatgtacctttgtccaaaactcaagctctttgtgcgtttccttcgcagcataatcaaagtctcttaagagtttctttttagccacattagggctaattttgttacgctttacgacagtcttcaagtgattctggaaaataccatagtcatgggtctttttattctctaccttcagacctaactctgactcttgtaaggctatagctgctagagtaataccccaacctttacccatgttattctcaccatactggtaagcttttaacatgtttactttttggctaattgatagctctgggcagtcaactgcataagataagtgtgctgtaaacattaagcacaaacctagaatcaatttcttcattggttctcctgtttagtttatcgtgacaacaattatacagcactctgcacaaaatacaaataaaaaaggccgccgaagcagccttttaagaaattacttattagatttcacgtttacgttgagagattagttcaccagcagtgccaacgatgacatgcaaagcttcagtcttaccatcccattctttcagcactttacgttgattatcaacgattgctgcaacttcataacgagacgaacgcatcttcatatcgttgtaatcagttggaacagatacaacatctcgtggatggacacgaaccttcagaattgtatcacctgagaagcaacgaacataatcccaagcaccaacgtgaagaccctgagagcaagttacattacggttattatcaaccatccaacgtggcatttctacaatgttacccaaatcattaggtactctgtaggtgtgggagtcaaccagcttgccttcacgagtagagactttcttccaaccaatgatgtatccttcttcatcaatttcaacatcaaggtgagatacgaatccccaaagttgttctacagaatctttagatgggttttccatcagtttttcgaagaacatcacaagtcgttcaaaacctttatctccagttttcatcatgtgaagaatacggtcaaccagagtagaacgcatctcaacagcaccgtagaataacttgtcacctttgatggtgatagcaccctgagtgaagttttcgatagacttacgaatgttcatcagttcgaaagctttcttatactcaccggatacaacagccatcacgatttctttgtagttcggatgggtagattcaacgatttcagagtctgcaccgaaagtcatgataacagagtcgccagtaatcatgtactcaatctggttgccattctgcatagcttcatgcagcttatttaccggagctttctgtacatcctctttaacagccttttcaactggttttccagctttctttttaactgatttagcaacttgcttcaaagtcttcgtagctggtttagaagctacctttttcttaccttttaaggttgcttcatgacgctctacagcacgaccaactgaacgggttgaagtattgaacttctgtgcaatcgctgttttagtcagcttaccttctttaaccagttcgtaaatttctgcatcaatctgtgctttagttttagtagtcatcttattactctctcttgttagttaataaatcattttgtaaggctattctaaggggctttgaagccccttgtcaaacactttaatcgtaaattatagtcccttctggaacacacttcacatcaaagcctaagaacttactcacttcgatgggtgacactttattccaatctaaatgggaaagcaagaagttttcttgttttctttttgaaaggtagtttgtcagtttgataaccatgcggtcacccgctttcttaatctttttgtatagttttgtatcattgtcaaggcatgacttcaaatcctgaagaacactgatagtgtaagtgtatgcaaacggtgcagccacatactgaatcttaccaaacattgcctcaacagcattctcattgccttctaagaagatggttttgtttgtatctcgtgaatagcaatacccgcgagaaatcttcttgttattaaacgtaaagtttctggcaataatccaactacttgtaaggtcaaggacaccattcatatagatacgtgtcatatacctgttatgattaatccagtgaacatcagttaagctgccattcaatagtttctcatctacttcaatccagtcttctggtatctttttccaatttgcttttcggaaaacatagactgtttttcctataacattagcaattgttttagctacatcttctggggatgagcaaaaacattcaccatcaactgtgtcgcctactgccttgatataaagctggggttcttcaattgtatctaggtcttctgacacctctgtgtatgaagctacaccctctgccggtacagctttccagagttttacaacaccccttacagcttctttgcgctggtaatggtgttccttatcagacattttcacaatctttaacaagcttttatcaagtttgtgcagattgattaaatcatctaactctttttcagtcgagaatacaaacacaataccattgtatctgtgaaacagacttgattcgttggcatagtctcgacatgcaccacgcagaatctgattgcggcctacagtcttctcagtaccgtttttattgcgacggtcattaatcacgaacaaaaactgttcaatttggcttttacgcattgcgccaaagatattgaacatacttgcctcttgagtgtaggaaagtgctgttgcacgaatcttgctctctaaagagttgaacttgacataagcaactgggttataaagataatctactttagggatgttgtttccgttcctatcaaccttaatattacctttaccgtcacgttcataaatgattgagccgtcttctgcgtagataatcccacgacgaatgtttagtaattcttcttccagagtatcaagtttaacaccaccccactctagctttggacacacagcattaaacatttctcgtgagttcaaacgcaactccgcataagcctgtgcagcatccataagtgtaggttggctattaactttcttgataacatcctttgtaattgcttcagttatctttttagtagcctcaatgataacattttttgtcgtatcattcatctgcaatgcttcacgagaagctgcaatagcaactgaaccaataggcatgtaaatgtttacaaggtctacgctcctacggaaaaattctggcaagactttgaagaaatcatcaccaagtaatgcttccatattaactggataggcaatattacccattaccacattaaaatctgtcctgttgccactagaacgccagctttgcttatgaatcatagcatcataaacacctccttcacgggcaatgacattcatatctgctaatacatcatcatatacaatattactttctggttttacagcaaagtatgagtatacgttaccagcctcttcaaagaactttgaaatacgatggtcagcaacagccacacgtacagctaagccattaggttcatttgttgggttagtagtaagcttagtcacttgagggataccattctcaaggtaaacagagtatttattaacaacaccgtcaacatagctagacactgtgaatgactgagcaattgcaaacggtgactttgagccgatacccattgcaccaatgtagtcattagagtcgttcttcgtagaagccccgtagttcaggtacaaactcattactttgtcatgggttaaaccagttccaaagtcacggacttcaaagtaaggctcaaatcgagtaggtaaatgcacatggaatgggatgttctcttttccagcttctttctgagcatctactgcattgcatgacagttcacgaatcactgccctttctttgaatgtgtatacaccagaactcagaaggctgaacatttcaggtgtcattgtaatctgtgcttgagatgtctccaaagaagttgaactcttaatcacttctgcgtggtcgtttaccatgcgcataatactttcctcttagtttgctgttaaattacttattaaacattttaccagaaccaccacaaatagggcaacaacctgctcttgtgtacccttctccgttacagtagtcacacttcttgtgctctgcatagtacttgcaaagaaggtagacaaacactgctacactaccaagtgacagtaaaatttctatccaatatgcttgcatgactcacctctcatgtttttgtaaaggataaagcttctgtcatggacgatacttgtagacactgcaaagttactttcaagtatctgtttgtttggattgtagaagctttctttaaactcgtcaagtgcaaattggtggttgtctggaagaccttttacacagacttttattgtgattgctgctgcaaccttacccgtcagttcttctttagctgctactaaaattttgttaaggaatttatgaccattttcaggtttcttaatgttttcccaacgttcttccaagacaacgttaatattcatctctttgattttcatgtctttctccagaaattaaaaaggctcccgtaggagcctcttatcatatacttttaaagctgcttgtcaatattgtttcgaatatcaccaagagttgtataaccgaactgctcagagtcgctaaagactaaacgtaaagcacaagctgggtggtcaagtacatctgcaaaactccggaatccatagccatctacagctttcagcttatcaccatcccacatgggtgctacaccaccaaaggcagacttcttaacaccactatctgttttagggtcttttgcaagcataatctctttaccaccaatgcttgcaagagttgctttgacagcaaatgcaaaggtgtcacgagtcatgtactggtaagtgtaagagcctacaccaaacactacgttagagcttgcaaaacccatttcatacagacgcttcaggatttcgtttgcacgttccagcgtgatagagtcaccatagataaggccgatgtgctcatcaagtaccttaaatcctttagagttaatagttcccccaaagatgttgtacagtgtcttaatagctccatcaatttcagctacaggacgtgttacaacgtttgcagaaccaaccatataagcatttttcaacatcactgtatcagcaactccaaagtcttctctgtcaacaaccatctcgtagccttctgacagtagccatccagcaataccgtaactaatgttttcaagcttcatgttcaggacagagttcagcattgtatcacttgcctctagcttgcttaggtgctcgtagtaagcctttttagcacactctaagtggattgctttataacctgtgacaatatgtacagggtctccagagtcagggcgaattaccagcttgccatcacgttccataatttctttacgaagttctggtaagatttctgacacagttctccagaagttataagtatctgaaacaatacttgcaataccagttgggtaagtttctgttaagaaacgacggaaggtttgcaactcacctttaaatcgtctttcttcttcaaccaactcgttaccaccttcccaagcaatgtttgcacacatcacagagtgttcagtggctggtacagaactaccaatatcagagattgggtaagactgtccatagatgcgtttagctgtgtatatagcagggaagctatcagtccctttaaagctggttaagtgacctacagcattaaatgcgtcatcagtaaagccggacataccacgcatagcaaagtcatggcactgataaggtaaatgtaagtcgttgtcgcaagtaaggtcagcccacttcttacagatacgtttgtagtgcaatgcgatagtcgcaatggtgcaagccttccaaatctcagcagagaaagcatcttccagataacctgctacccaatggaaacctgaaacagtgttctggaagacaatcattggaacacgcatagggacaactgtgccttcttctacagcgtatacttcaactggtagataacctaagtcgtgaagtgcttcccaatgctctcgaccgatagcatctttacccagaacaccattcatgacttctaagatttcatcaattgcttcttttttatcacgttcaaagaaagtggcgttccagtggtctatcaagtaatctttaacaaaacgttgaataccaaaagccactacaccgtcaattgctaaaggactgttaaaccatttatcactacgtggtgtcaggttcaacataagatattgcgtagcatctggatactgatatatatgtgatgccttgtaagcatctgcattaagacctgctggtactgcgtaaagtgacttactcatattttatctctctcttagttatgtcttgcaaactcaccatgaagttctattcgctttttaattacagcttcttttgcttcttctaccgttttaaatcttccacaaaagtattctttatggtaaagcatgactcttgctttgtaaagacctgtttgtttacaaaaacttacacccttcacaccagttttattattcttgtatatacccctattcctctgattttgtgactttgtgctaagtcttaaattctccaacttattattagatttatcaaggtctatgtggtctatctcatatccacttggtatctcacctccagacataatccatgcaatattatgtgcatagtacctcttcttatttatctggacttggatataacccttcttagaccttgtgccagccacattaccagcaatagcggtactgcaaagggttactctccaaattaataaacctgtatctggttcatatattaggtatctttcaaaataacccttattcatactgttacctaatcaaggtttgctacagtaacttgactgtaatgtgttaagccacggtctttagcttcgcctaaagagtttgtagtgtaaatatggtcgataccattgtcaagaaggttttcaacatctttagagaagataccatgtgttacataaagttccacacgttttgcacctgcttcacgaagatgtttcgctgcttctacgaaggttcgaccaccatcacaaatatcatcaagaatcatgacagttttatctgtcaaatcaacatcatcaaggattcgcataccagttatttcaccagtcttaaggttgcgtactttagacattgtgatatatggtttatccacctctttagcagtctctgcaatcttcttagaagcacctgcatctggggctactaagtaatcaatcagagggtcatttgcatagtggactgcaatctccttttgaggaatactctggaagcagttgaaaaggttatctggaacgtaactatgagggtcaactgcacagactgcatcaaaacccattgcattaacctgttgtgcaaacactttcaaagctgctgcatcgcctttaaacatgtgacggtcgtaacgtgcatttggcaaatagtaaaagatagcagtcttcatagcaaacttacgaggtactaaatcatcaattgcctctttagcaagtgccacagcaaataatgtgtctttgtcataaccctttacaatcataatcacgttgttgatggatgatgcagcataagcagtaaaatcaacaaactctggtgaaaaatgtccaccaatctcaccagaaggaaattggacgatgttaaactcttcttcatgagtccctttagttggtgaatgaactgtaacacggatagatgttttcatagttttctctctcaatcaaaagttacgtttgttactgccattgcagatttgcattttgcagggtctacaacgtgataaagtacactacagttacctgtgctgtctggtacaggctttacccattgctgctttatagttggctcccctaagtctttgtaagagccatctgtaaagttgtttaccatctcaagtgcaattggttctggaacatgaccacgtatcatgtacatttcacaaccattaccaccttcactgactaatggtaaaatcttccacttctctttagccattataagttgccctataaactgtctcgaacttcaacaggagagatattgccaaatctgtatagttgttgtcaagcacatctggcatattatttttgatatatttctcttgctcttcataggtcatcttaggtgtgcttagaaggttatctccttgcttctggttatcgagcttagtctggataaaccagtttgcacagtgatgctcaccaccctttgtaacaggtttgtggtggcctaatgtaaatgcttgcttacctgtatacctgcaaagattgttcagtgttgcaatagtgttcttcacaacacaccattcatacaggttatctattgtgtagtgtgggtaataacggacaagtgctctttcacggaagttatcacgattccaaagaaccatgtgattcgagttagaagggtcgtattggtgggagtcaatgaactcttgacgttcctcaaagctgagtcttaggactgacattgcagccgaacgtttcaggtttgacagatacattttatctccaaaataaaaagggaacctttacagttcccttatagtatctgtttactgagctactttcaagatgcttgtgaatgaaatctcactctcatccataaactcttttgcttctccagtaacttttacaaagttatctaggcagataatcttcttatctttcttgctgtaggttagcttaaccttttcaatatctttcttagagtttttctcttcattaaagagcttcacagcttctttaaatggtagatatgaaccatcatcatcactaataaaacctgtaccacaatagtagaagttatattctttagccataaactggcacagtacgaaaatctgtaatttgcgagtgttatagattttgctcatgattatttagccttcttattacgtttacggttacgagctttcttagctgctcgtttaatagctgctgcaccagacggacgatgggcttgtttcttaccacctttaccacggcctacatagatacttttcataatctcattagccagcttctcatccatcttaaagttctgcataagatgagtcacatcaacaccagtgagcatacctaatgaagctagtgctgcttttacttttgatttaaaactgttccagagtcccatttcgtatctctctcaatcttttcacaaaatgttttaagttcttcttcagtgacaccaacaatactgtcaccaacgtttaaatttgttttgtagaacattgtgtagttacctttaccgacaacttcaaatgttccagccttctcaatctctgctaaggcttccattccaacattaccgaaaagtgagtttgtatactttctccactcatcaaggagttcggtcttaactttgtaagtacctaataaagcactgttaaaagaaagaaccattatctcaccttttccgtaacctactctacgacgagacttactcggctctccactgacaatcaccttgccacccatactcttttctccagaggttttggttatcagaaccacgatatggtttaactgttggtttagatgaatcatacttaccatcaatcaccacgtcaacatatttcatcacatctaggtgaattttttcgtgtaactgaaaacctgtccagagccagatagacttctctggataaatagttttaatacgtttgcatatattggtaacctcctgaatatttctatcatccagaggttctccaccaagtattgacaacccactgatagcattatcacccattagctggatgattccgtagaggtttgcataagtaaatactttaccagcattaaacttccaagactccctgttaaagcagccttcacagtgatgcttacaaccagctacgaagaggcttacacgaaccccttcaccattagctgtatcaaatggtctaatctccatgtaattcatctagttacctcaccaataaaaaggtgatgtaagcctatcaagacctacaccgccttgtcaagttttacataaggttattttttcttacaattgtcaaaatgatatcgagtcatgttaccagcaccaccagtcataccacaatgatggcaagttttctttttctttggcttttttccggcttctgacatcctcttccttgtttctatagaccttttacaaccttttgattttgtattacctatttgagattctcctaatcgtcttcgatgttcttcagtgaaaaccctacctttattcacaatagataaagctttcgagttcaaagcccttaccttttcatagtctctggatgatattttcctatctaggccatcatgagctagtctgttccatgcaaaccataacttgtggttgtttggatacatcttaaccagtaatttatgagctatataatgctctctaggtgtaagtagagcaatattatctccactaattttatcgccacctagacacactggtatgatatggtgtctttcataacccttaccttgacatttgtagtatgtaagaggcacacccctttcagaatgtgccttcttaataattgcattatatattagttcgtaattcatttgtattctacatagaaaccctatccttaatttctgccatcttagcgtcattcattcgagactgacctttaatttttgtgaatgacaagtacccgcacaccctgttaatcacagagatatcgtgtgaatgacaaacctcacattcttcaacatcagcctttggtctgttgccacaatgctcacagattgctaagtcaaagttaagtccctgatagaaacctttcaacatccctcttgtaatacaactcttaagtgctggtaagttttctggattagccactcttacatactggattctgccgcctctacagatatggaagaagggttcttctaagtcctgcttctcaaatggtgtaatgtcggctgcaacattcatatggaagctgtttgtaaagtattccttgtcagaaacgcctttgataacgccaaacatatctctgaactgttttagctgagttccacaaagtgattctgctggagtgccatagactgcatataagaagccatcttcatttttaaactcttcagtcttcatgttgatatattccagaacatcatatgcaaaactacagcttccaacttcatgaagtcgtttaccttcagcaagaacatctagctcatcaagcgcagtaaccccaaaagaagctgtgaaggacttcacgatatcccagccaaccttgtcagtaggtttcttattccctttgtacagaccaccttgtgtgaatgcaagagggttagaacttgctggcatattagcaatcatttcgtaacgtttcttgtggaagctgcgaatcatttctaggtacttatcaagctctttccagaaatctaagccattctctttagaatactggtaaatcattggtaagttcaaagatacagcaccaatgttagcacgacctacataaaactcttcaccatattcgttatggtatggtgataaaaatgctctacacttgttgttcaggtaagttcgctaagcttaccccgctttattcaagctgcttactgtcgccagtaagtccagactatatcttctacttatttctaagtagcgtaccatttcgagtcgcttgaccctacaccgctacattcatcacggttagtcgttcggcatttagatgtattcaaactcatattcgaagttattatgctcttttacacccttcaatattgaagagatggtcttgcgattgtgtccaagtatattggataactctcgtattgacttagcaacaataacttcctttgtcactttgtgtgtggctttcacggcatatgaacgcttgtggaacttgtagcatccgttctcataaccttctttagcattctcagaatgagtaccccattctaagttagatgcgtggttatttagtttgttatcgtccttatgttttacaattggaagattatttgggttaggtacatatttctcagcaactaacctgtggacatacatgtcacgattattcttaccgtaaaacctcactttcatatacccagtgttggatttccactgcgtaagctctacaccattttccctaaagacttttccatcttcagtgacgtgatagtttggcatgtaagactcctatgttgtatagtttcttacatcgtacatcatttagcacaggattgtctacatctgtagagtttccctgtttaggcacgttttagatgagctatagagcctgttaacccatcggggaaattaccttgccagaacgctcaaaagcctctgctacagcaccatgtccagatacacttaagaaatctggatacatagctttagagcaacactcaatagctttactgtacaggtggccttgacagatattctcattgtgtctcttctggtcataaatataaaccaatttagggaatacaacaggcttcttgctcttaccttgtccattcatacgaacatctaggagagtgctcgcaatcatgtattgcagtcggttatcttcattagacatatctgagtcaagcaacccgaatgtcaaagttgtgaatgcaaaatcaccacggctacaaggtacagtatttagtttcatttcaagagactgaaaaccttgagttaattcaatctgtagctgctccatgacatagttgtggtaatgttctttaggaataccataagctgttgctttctcagcatgatagcgtagagacttcttagcatacggcacaagtaccttatcaatctctgctaaagtaaagccaccaaattgctgtgcagttgctgaaagaactacgtcaccaataacctgtaaggctgacagtacagacttcggttcacaatattcaatgccagacatttcaaagccacctttcaggactttaccaatgtcaaacaggcaacagttgataccaccaaaaattaggtctcttaaatcatggatatagataaaccctttttcaatggcttcaagttcctctggtgttaagtggtactgtttaaagatttctttagtcagataaccacgaataattgaaccttttgtagaaattaaactgctgtcaaagttagcattctctctgtcacctaagaagagtgtatctttggtcttctggtagagttcatcccaattttgagcaacttctttacggtaatttctatatgttgagtaagactcataaatctcgtgattgacttctgccaaagcaccctcaacaatactgtgaatatcatttacagaaattagcaaattattctgcttagtggattttaccagaagcctcataaatgctgactcaagagcttgggtaacatctggtgggagttctttatacccaaccctactagctgactttgtgactgctgctaaaacttttttgatatcaggttcttcgagtgagccattctttttaataatctgtactttgttcattattgcccctttacatgctaaaaaggtctccgaagagaccctttcattttaaatctttttagaaaacttcgcaaagagttctcttagtttttcagtgatacctaactgtatctctaatatttcgaagataacccatagtaacatggctccaaacaatgaaccttgttcaaagtcagtaaataggttaacaataagcataccaatcacaatagctggtgcatcaacaaccaaaccttcccaaatgcgtttaagcattattcacctctgccataaaattctgtagagtcccaacaggttttaggttttgtccatcagttttcatgatgaatggcatctgacgaactggcatctgtgcaatatccatcaggtctgatagctcatagtcctgccctaacattctcacaacatggtcaataccacgagcttttgcaaaattctttgcagtctcacactgagggcatccagttttggagtaaattacataagtcattaaggaacctctaaaaatccactattcaaatcatctacaacagtattcaataggtacgcaccgttctgttgctcctgattagcattctgctctttatcaatttccatcttcttaatcatatactttaaaggtggttctttaggagctacaaaatctctgggaatgccaaacatatcatacagtggggcagcattatagtaaacccactcatgaagaagctttgtatttaagccaactacagcacgcccttcggagaagatataatacgaccatttctcttcactttcaactacttcatctaagattactttaatctctggaagaatttgttgaaaagctttctgccactcatcatctcttaaagtttcttttaaaacttcaatatcaattttagtgtgaaggatttcgtcaagcataatcttctggacagcttgagcaataccctgaaatttatcttgagcatcaagtgcaaaggtacatgcaaaggatgccataaaagatataccttcaagtgcagtcactgcaaacagaccttttagaatcactttatggaagtgtaaagggtctttgtccagaagtgaatcacggacataactcagtcggtagtttatcccttcatccagtaattcttcaagaacacgattcacagtttttaatcggtcttgcacagcaacattctggttaatctcatctaagattgtttcagggtttttaatacattgtcttacaatctctgagtaagtaagagcatgtaggttttcaatctcagactgcttcataattgcagttgcataaatgtcatcagagataaagggtgcaaaggcaaatgccaagctcttagcaacttgagtatctgcttcccattgccacttaagaatctcaagcattacacctgacattgatgctgggacactctcaaaatcaagacgtgattgttcaaaagggaactcatcttctgaccaatcttgtgctttttgttgtttataaagctcaaagatttttgggtagtgtttattaagtgagtcaaaagtttttctctcaccacctaaaaagattgggtgctggttaatcataacgtgatttctcctttctttatcatttctaaggcttgttttctgtctaaaacttcccaattttctttgttaaacatctcataaggtcttgcatagattttaccatctgctgtagagatgtaagagataccagcaacccatgagtcatcattttgttttatcatcatgtctgtgctactcacatagtacatcgttttccgaggcttgtggagcaagtatataggtcgctcatgtttttctattaaatctttcatggtctctccaaagttatttttagagggtcttttacgaccctcatagttgttaaaactaaacaccacaaccctcgcaataagcatcttgcagtgcagatttacctacaccaatgcgactgttaaggtagtacatggttttcatacctaccgagttggcataaatcatgtacttcagagcttgagccaatgataccttcttagactttgcatagtcaacatagaagtctgaagagatagcttgaccagtgaacttttgaacaattgcataacaatcaatcatatcaaaggtgtcaatatcccaagcaatttcatagacatacttcaactcttcataatctggaacaataaacagtacgttaccagttgcagactttttagttaaaataaagtcacgaattgggtacaagccatttgtcgtattagttgctagtgaagaactctcattaggcatgtaagcttctaatacagagtttcggattccaccattttctttgatacgttgtgctaagtcatcccaatcatatcttagttttgcatcatgcttttcatcaatcttcttgttagctgtctttggaggaacccagccttcaggatacttagtgaacttcatgtactctggcacgccacgttctttagcaagtctcagagaggcttcatgcagatagtaagagtgcatctctgccagttcatgaagttttgttttacctgctcgtgaagagtagttcacgtagttcttcgcaaggtaatgagccacatttgtaaggccaatcccaacagaacgacgcttctgaacatggttacgcatcgacggatacggataatccataaggtcaataacggagtcaaccattgcaagagcataataagcaacgtcagcgtattcatcttctgaaattctccctgcaaccaaactagctaggaagcaaagagccacctcaccatcctctttcacagcatcgtctctgtaaaggtctgtctctttctcaaaaccatacactggcaacacaatttccatacaaagatttgacatcttcaatggttctttaaatggtgtatgtgtgttcgcattatttgtgaagaatggatacacacgacctgtagcataacgctgttgaataaacagcttagcaatttcacgagcctttactcgtctgtgcttaactcctgaatgtactgcgtgaccaactgccatagcaaactcatcagcagatgctgtgtagaacatgtcatagagttttggtgcatctttgtaagagaatagcaaccaatctgtatcatactgaacacactgccagaaataatcgtttgtgccgaatgagtagtccatctcattaatacgtttagaaggaaccgttgtagggtgcttcaaacgcagtaaatcttcaatctgcgggtctagagcagtgtagaagttattagctgaaccaccacgactcttctgtttgtttgcctctacagatgaacgtacaagcttgtaataaggtagcttacccatgtgttcaatcgtattttgacggataccatcaccaatagtgcgtgtctccatcagcataccaataccagcttgctttgtggtcatatcataagcaacctttgcagcaataccgagagactcagcagtatcatttgccttaatcaaacagcatgacgcataacctgatttagttgctcttaaaccatttaaataaggcgtaggagcgttaatcttcaggtcagataggtaagtgtacagcttgataacatcttgcagtctacggtgctttggttgcttctcaaaggctttcatagccatacccataaacataaattgtggtgactcaaaaagtcttcccgttttaatatcacggataccatacttgtctctgaactgtttcaagactgcataaccgtaagagatatcttttgagtgtacgatgtaaccttgcaggtattcaagctcttcctgtgaataatccatcttctcccaaagtcctgctctctccatatttttaacgaaggtaaccagcgtaggaaccttagtaaagcctccaaaggcttctttgtagataatacccaaaagcagccgtccagccatatctgagtactcttgagtttgtttatcaacacaaacatcaatcatggcttggtgcatctcttttgtagtgcaaccctcatagacacgtttcatggcttccatagtgacttctgaccagataattccacgcttatctgcccatgatgcccacttattcagtctttctgggtcaaagcttactactgtaccgtttgattttttaattgtcttaatcattttcgaatcctacagatgaaaagagcctccgaagaggctccctagtttaaatcttgaaaatttgctcattctgccacatatcgtaaaacttatcacttactcttgtgactgaagaagtgtgcatacaattcagggagaaccatgatgatgtattatcatccataattgtttcaagtttttgtgtaacgttcacatccatgtctgcaacaacgtaattacctcgcatcttgcaaacaattcttccaaacaagattgcacttctgcctcttcggtcatcacagtacataactgtgtccccgtgcttaacatcttgtccgatactatcaacacctaatttagcacctgagataatgtcatcataagatagcttttttgctttagacacggtatttctccaagtttctttttagatacaaccaaccatagtcagtcctttctacacccataaagagtggagccatcacaactttaccgaaagtattcctgtgttggcagatttcaaaagaatactctttctcaatatcaatcccgtatttgtacaggactgcttttaaaacttgttcattgtccagaagtgtatctggagtctcactatatttttctagtaacgggtcattcataaacaccgtcatagaaatattgtagtttgagaagtggctcttctgagccacaccctctttattaatgttctgtgaatccattataaccaaccccttttaaccagcacttcaggttattagcatcataattcagtttcgggtatgaggttacatggaactgctcaccatcatagtagacaatatctgcaatccatagtccgttctctttacagaaatctttatctgctttagaggtaattggattgacttctacaaaaccatctacacccaaatcctttaagctacctacaatacctttgcagataacgcatgtctcagatactaccacaaaaagttcttggctttcaagctctacaatgtattcaccaagctgtactttagggagatttgattgcttcataatcttcccatcggctgcacgaacaatcgcataccactctttaccatcaactactgacattctgataatacactcttgaccagtacgcttttcaatgtctgcaagacgttttaaagcttcttcataatcatctgtgtacttcaggttattattatgacaaacagctttcatagcaccgttatggtcatgttgtgacaggtaaatcaagccgtcaagaacatattgtaaatctgcctgagcatccagtgcctcaatggggtctttctcttcaattgcttttacaagctcttttgcttcttcaagcatacacagagattgagattttaaagattcccaatactcatcactgtaaggttgcttttgagtgtttccacaacgaaggttccagttttttactgattctcttgagttaaacattcggactccttaaaatatttgttaacctttagctctcgtgtttcaatatattctagatgctcacgtagctcttgacgtttaagcattaggtgctgcatttgagattcaacagcttcaacttctttaattattgaccctctagcatttgcaaggatgcgctcaagttcttcaatcttgctgtcaacttttgctacatgacttacagctttacttttgttaaacattttattctctctcaatagttatcaagcacaatttgctttcattaccttatggattcttttttcagcatcttcataagtttctttggtaataaacttaattgctgcaatattggcattgtagaagagtctgagcttcgagtcaatcctttttgtcattacatcgaacttatgttgaaggtttgcttcaccataaactagaccaccttttgtgtagtaggtttggataatgtaaaagtcaaaaaattcttttccaaagctttcaatatcttttttgatatactcagaagaagtctcataagtcatccaatcactttccttagtgactatcttcttccgagtcttaccagcaacttttcttttggtcacactgttaagctgttttttacccaaatagtactgtccagtctttttgcagtacactaggtagacaaaaccaaagtgctttgctgggtcaacttcaccacatagtgaaatccaatgtccataagttggacaactcccaaaacctttaactttaatcattcatgagcttctccgtgatttgtaaactctctatgaagttcttctcttttctttttgacaacttcttcagcctcagcaacagagtcaaatagacctagatggtagcaaactttattatgcttaacttgtgcagcccatctacctctttgcttgtggtaatatacacccttcacaccagacttattatctcttcttttgactgcattacagttgttgtctgacctgctacactctctcaaattgtcgaaccagttgtcgtatctgatacaattcttgtggtcaacaaattttgggaggtatcctttcatatacaagaatgccagcctgtgtgctgcatatctttttccgaagagttttatatagatataaccgctatggtgtttaaaacctgctactgagccagctttggccttaccttttctatcaactaaccaagtaaagacccctgtttcggggtcatagtgcaggtgctctttaagagtttgttgagttaacatttggtgtccacccatacttatcaaaagtgaaatcgtctttcttatttctttcctgataagctaagaaaaagtgttgctgcattaactctaagggtgttctggtaattgtttgaccatcccacgagacataagtgtacgactctttcttagcataaagctcataaattgcatcaagacactctttgtaagtggttttaccctcaagggctttcattatagtaaccttgccaacaccctttaaaccaaaataattatccgcattatcaccagccacggcttgatagcaaagaaatttaaaacctaccccaactgtcttcttagcttttggtgttgattttattgggcaatcccatatttcaccaacattgttatcagcaataaaaattaaaggtgatttttcataggtcatatcaatgcagtaagtgccttcagcttggcgaaggtctttatcaatactcattaaggcagcctttttacccatcttttcagctttagcaattacgatagagtcagcttcaaacccatcaagaatcaatttgaactctggtcttgacagaagatactcacgacaagcaactaagtgtgttggtgtgacagcatctttacggttcccttgatattggtgctcaagacctttaatgtctttatgtttatgcacacctttctctgttaaataacctacccaagttctttctttaccaacaatcttaagccattcctgaagcacctgttgagtagccatgatagcttctttttcactcttagcttctttccaagtctgtctttcccattcatcttcatcaaatgtcaggccaagctcttccacaaggattctctggtctgctaaccatcttgcagcatcttttgcattatcaaacgaatcagattcttctgctgtgagtttattgacatatttatattttgctttctcaactacacaagcacctttataggcaatactatcagagtcaataaaaacatgtgtaactgaatcgggaagttttgttaatgtgtacttctccattatggctctccatatgaaaaagccccatactaagtacagggctttaaagtaacttttagagattagtcttctgtatcgaagtcttcatcttcttcgtcatctgggtctggcaaatcttcatcatcaccatcatcagaagcgttcgaaggtttatggtctgttgcgtcttcttcagtgatttcaccgttatcttcaacaccatcaagaccaagcatagccagttcatcttcatcaagttcaggttcaccattagcaccgttaccaccagtgtaaggtacaagagtatcaatgataaactgttcctgaataggttttgtcagaacattgttctcaaaagtgtagaagtgagtagaaagaatcacactaccaaaagaaccgttaccaactgcgatatctggatgaattacgtcatagttcttgtcatcttcatgtttatcagatgcttgagctttgattttcttcatcggctgcttaacagctacacgcttaccatttacttcttcaatcagcattacagggaatgactgtttagctgtccatacagcaccatctttataagctgctgcacgacttactttcaagatgtagtaagtgtctgcttcaaaaggtggcttacaaccaaacttctcttcgaagtcgtctgcatcaactgcttcagtagtaactttgtcccaaccttctggatttttcttagacttagtaaactctttaaacagtttgttaccgtcttctgccagaattgatacgctgtagttacagtctttgcctgggaatttcttatcaatagatttaccttttcccggacgtggtgaagtgttcaggtaataaaaccagacatctttcagcaggtaacgcagagtttgacgttcagtaccgttgtacttctctaccggagctttcattttaacaactttagacattatttaaacctctatctcaatttatgaagagtaccaattctaatttgttgatactctattgtcaaatactaattactggaagttgtgcttatctttagaagctgctttacgtgcagtttttccagttcttacacgtttctcttcatagtattttgctggttttccagcagtggcttttaaggaatccccaaaaactttttcaaatgctttagagtgtttcatgatattctccgatatacttgatattcaaacacatcttctttaattataaacagccaactaatattatgctgaggcagcgcaatgatgactgtaatcatgctctggtgaaaatcttcttttatctcaacctctccatcgcatttcatgaggagcattctatagaacctatcaatctttgtcaaacactcttcctgaaatttatttaaacttttttcttcaaagaagggtgtgaacccctctcttttataactatcactcagtttcgaatgggcagtcatctgcatcctcacttaatacaggtggaatcgttgagctttgacgctgctcttcagtatagacttcaccagtctcacggtcaaacacttcatcctcataatgtggcaaagagtcatcgtaatggtcttcagcttcgccaataccaaactgttggcgaatattctctgctgcaccatcaatgtcaactccgcaaccagatgctttgatgaggcgtcctgtatctggattgtaccaagtatgaccagcaatacccgttgacttaccgtgacgacgacatttagttagcttgatttttgtcaagtttttcttaacagggtctgggtcaaccttgttacgcattaacagaatgttgttcatagaaatctggaaatacgcaccagagcctttaatatcctcttcagagatatccccaccttcagagttagccttctgaccacctgcactcttacgaacgtgacagacgttcacttgtgcatactggtagcgtttgcaacgacgcaatagctcagacaaaacttcctcttcatccgtatctgaacgtgacagagccaacgtaatagggtcaagaataataatcttacagtctaagctattaacaagatagtcaacaaactccagtaagttatcttggtcaattgccccttgatggtctacgatgtggatacgacgacctttagatagttctgcgtgcgctcccttcaattcatcccaatcacgttcgtcataaggaatctcagaaatctgcttgctcaggtggattgcacagagcatctccatcaactcttcataggtatcttcaacaggaattacaccaatattgtaatcggtatccttccaagcagtgtaaatcatttcacgagtgtatgcagatttacccactgaagatggtgctgccagagttgtaatctcacctaaaccgtaaccgccataagtcagcctgttcaaatctccgaaagattctgggaaaggaatcaatggaatctgaccacggttcttcattgcctcaaaaccatctgcgaagttcttgataccagcagggcagtaacggggtgcattgtagatacgctgcttaaatccttccagaactgtatctttctctttatagaactttgtccaccattcgttaaggtcttttacaccctctggatactggaataaacgaaccttctcaatagggagaatgccagcagcctctttagtggctttagcacctgcttcatcgttatcaaagcacaagtaaatttcatcaaatgatgtaatgtactgatagttgtctttgatagacttaatgtttgcacctgatggaacagatacgtgacagtaattcttacgacgagacttgtccttaatcgcaagagaagtcatatagattgctgtcgcacattccatctcaccttcccagatgaatagacggttaccaccttctggagcaatccatgaaccgaacattgccagttcacctttaatgtctccaacaccacctgaaaagtcttttagcttacctcgtaggtgttcttttggatggtcttctgggtaacggtgacgaacacggtagccaacatgttctagcttaccatcttcattacgtttgtaagttggatagaagtgtgcatcaatttcaccgtcactgtcaatgtcaaccttgatacctaagcgttcaaggacttttgcaggaatcttcctatctttcaagtccattgcttctaggttttctttgacatcttctaaatccattccacggaaagtacggtttttattgtctgaaccagtagaataagtgctcacgatttgtcctttatcaaaatcccactctgggaaacctttgttacaactaaagcaagtcatcgaataagaatcatcgtcatgatgatagattgaaccagcatctgatgaaccacaacgtggacatgcacaatgaccaataaactgaccagcctctttcaatttacgacctttagacattagcacctcttcgttgtagttctgccttcaatccattttcaatcttgtccagttcatgaatttcatctgcaatctctttccttcgtgattcaactctcttaagacgttcaatcattacctcattggaaagagatgagagttccactaaacggtggtcaataactttaaaattgtcttttactctcatcttcattctctcttttaaactttaatgatggctcttagcttgttctcaaggtctgcaagagtaccattattatgaataatgtcacgctcatattttgtagaaatcccattttctgaaacgtgtgatgaaatcttatccacattgtctctttttacttcaatagtttggtgtgcaaatctactcagccactcagcttcagagtcaaatcttaaatcactgattaagacaaaaccatattggtttctaagtgagcaactttcatagaatctaaccattcttttttcaaggtctttagaccagaacttgtcgcccattactttacggacaacttcagtaccccaaatctgttgaatttgtcttgatgagaatttatactttttgctaaaccccagacgtgtcaatagagtcggtttagcaaccttcttaagctccataatcaatcgtccggttaactctgacataagcttgaagtccatatggtaaccttcatctctgaaggtaaactccatagcttctgtaacttttgacatcagttcaggatatgataagtcaaaaacctgtggagtctctttagtttcaccatacaggtcattccaagtcaggtcaaatatctttgatgcagatagtttaaggttgtctgcaaaggccattacttcaacattgtagccgtactcatcctctaagatattcttcacaatagaacatgaggtgtcttttccagaacgtgcctttccagtaaatgcgataatattactcattttacccccattaattactaaaaagcccccaactaaggaggcttgtaagatttataaagacttagtgtagttgctcagcagactctttttcagccatagctgagagttgcttcacaaaatcatcaccgaagttaatgcgtagtttctcttcaatgattgaagcaccaatattcaccaaaacatcattgattgcttgcatactaacaccaccagtcatctcctcaatgaactcaatactcacacccatcatctgtgaaagctggattagtgcaacgatattcatcatcgtagagatagctggaatcatcagtgcaactttcacctgaagtggttctatatcagctacagagtcattttcaacagcttcttccaaagactctttagtttgctggataatctccttgattcgtgggtttagttcttctacaccccaatcaagtttttcatatcgtgacaacttctcttccattcgcttctcaagagcagccataacagcactagttgatgaaattaacaggtcaattagttcatcattacctgcgagtagtagcaagtctttttcttcagtggtcatggcaatatagtcatttttctgcatctcataaaaaatgaactctgcaagggcatcaacacctacaacgatagatgctaaagcaagtgttttgtcgcaaagcatcatgttgacctgttctgcaaaagcaccgttatcagacttgtcttcaggcaagttatagcttgcaggcataaactgttctgtgtagttgttaccacgaagaatcatagccatgctttctacagcattgattaagaacgcttcgtcaatacctttttcttcaagcatcttttctacatcgatattcatattatttctctctcagttggttaagtttctttctagaacattttaagttttcggatgaagaaaagtcaagtgtcttttcagaacgtggataatagtgcctatcccaagaagtttcaacatcgttaatcagtgacgctagattacacaggtctgtaccactttgcaacctctttttaagagaatctagtaaagcaactgtgtctttagctttacgtctcgctgtagcaacatctttcatatgctcaaatacagagcattttaagtcatcttcatagttttcagacaactctatttcatgttgtatatcaaccattctcctgtgatggtgagcatattcccgttgagcagcaatgtcaagttcttccaacttctgcaaagctctaacaaagtcagctatgtctgggtgaacaaacattttctgcatgtaagcctcttttaagtaactattaagttttaatcttttatcttaacgtattctatacgttatactttaaagctttttaaaagctattaaataatcttttaagagttttaaagtatctgtatagttaaactgttaagtaaccttttaagtaaaaacccacttcgcaaagattaacaccttgtcaagtgtattgtcaacttgctttttataattttttgcagtaatgtatggggttaatgattttagagggagtaaaaatggaaaacgtagattttaaaaacttacatttggttggtgatacagaaactgatggtttactccttgagttcactaaagttcacgtaatggcctttgcagactataaatctgacgatgaagagccacctgtatgggtctttacagatgagcctatcctcggtcacaagtacactaagtacattaagggtggtttacgtgaaggtgttgagtttgcgttaaaggcaaaacgactttgtatccataacggcctcggttatgactggtgggtcttcaatcacattgcaccggatttatggaactttgataatccaaaatgtaagccgtggagtaatttctttcaggattctcttatccagtctcgtgttcagtggatggatagaccaactccaaagggttataaaggtgctcatggtttggctgcatggggtgctcgtgttggtgttcgtaaaccagagattgagcattggggtgtgtggaatgcagaaatcttcactcgtgttgtagaagatatccgtattaacgccaaaactaaacgggcacttgataatgagtatctcaagcttaagaagtgtggcatagacacttatgaaacctacatgcgagctaaagaaacatctttctggatgagtcaacaagctatcaatggttggaaagctgataaagagcttatggagttccatgtgaaggaacttgacaagttgactaatgagcttgcttcagaggttgaaccacatcttcctccaactattaagaccaaaggtaaagtcactggagaagagtttgcaaaagcttggaatgagtatgttgaaacatttggtcatgcagatggactgaagagaattaccaagtaccctaaaacaaagtatcgtcagcaggtacgtaacggtgagatgcaaacttatgaaatcaagccatttggtaagccaactacaaagatttttaacattgaaaagagaaattgctatacaccaaccaacactgtaactggtgaagagtacaaggaaggctttgtagcaatgaaggatgctcgtgcaatttgcaatgagttgaacgcaaagattggtaagaaatgcaaagactggaaaccagtaaaaacagtcaaaactgtgaagtactataacagccacgtcgttaaccactttgaacttgagtcaagtcgctacacaggtttgattgatgcaccatatacaccaattgagttcgaagtttctcgtatgactcaggtagcagttgttaaagactacttgaaatcagttggttggattccagatgactggaactacaagaaagactcagatggtcgtcctgtcaaagtttgtcgtttcaaagacaataaaaagatgattacaaaacatcctaagtggcaggaaatggttgagcggtgtggtttgagttatgttgaacatgaaggtgtccagtacattgagcataactggtctgtgaagaagtacacagatttgcttgagccttgcttaatccgtacttcgccaaaacttactgaatcatcttatgatacgattgaaggtgagcttggacagaagattgctaaatactatactttgatgcacagacgcagaactattgagaactcaaaggatgatgaaaaaggttggttgaaccagattcgtcctgatggtcgccttagtgctggtgcaatggtgtttggtacttcaactgggcgtatgacacaatatggtattgtaaacgtaccatctggtgctgctgtctatggagcacctatgcgggaggtgtggacttgtgaagaagggactaacattgtttcagttgatatgaactcagcccagctagttcttctttgtaactttatgggtgacaaagacttcaccaaagcggtaacacaaggtaaagaagagattgagttcattcgtcaagaagatggacgctattactgcaaacactttgatgagtacctcaacccagagattgataagtaccttcgctatgactctgagaatgacctgtacgttgtctattcagggactgatgcacatacactgaacagtatctactttagcttgaacgatgagcaggacatcttgacttgtcgagctactcaggatgagaatcttcttcatgagattagcaaaggtcgtaagaaagctaagaatggcatttatgcgtcagtggcgcatgtaaaacgttgtgaattgctggaagcctaagtctgtaaagatatggtaatcagcagcgaagtctctgttaggactcctaaagcaaataacataactatagagattcctaacagagaaacgttcagagactatcgaaaagcatacttaatgtatgaactgagtagagtagggtggtaagctaatgaccattcccaagtgcaacggtagtattactactacgtgatatagtccgacactccgtagaaatgcggagaagttcataagagaactggtacaccttgcgagtgtattgaccagatgtattgttcggtgcaggtgatgagaagtttgctaagacgattaaagcatcaacaaccgaagaaggtgctttaactaagcaaacttactttgtacgcctccctaaaattaagaagttgctagatgacttggaagctgactacaaagcaactaaaaaggcacttgaagaggtgtttggtaagactgctgcaatctctaaagggggttttgtaaaggttgctggagcttggttgtggtgtaaatctccacataagttattgaattatttgctcatgggttcggaaagtcagattcagaacgaggcaattaaccttgcttgtagaagagcatgtgaagaagggttgacaaaattaaatggacggaaaccagcaattggtgctagacttttgctggcataccacgatgagaacagttgggaatgcccagaaagtatgactcaagaagttaaagccataactgactggatgtatggtcaggcatctaagaatttaggtttgaagagtgagacgcttgtaactggcacaggtaaggttggtaagagctggtatgaggtacattgatggtgttgaaatgattacagaaattcgtcttaaggagctattggactacgaccccgaaataggggtctttacttggaagtttagagaaggtaatgcaaattttaactctagatttggaggtaagagggctggaaactacagaacaaatactgatggacacaagtcagttcagttgctgattgatggaaggagttaccaagcaaatcgtttagttatcttgtatgtggatggatatttgcctgataaaaccttacaggttgaccataagaatggggacggttgggacaataggtacttgaatttaagggtttgtacagcttcacaaaactcttgcaatcggtcaagaaagtcccaatctgggttgccaaaaggtgtacagaagataaataaaaggtttcgagcaatgatacgtttacaaggtaaaaactatcatcttggtatgtttgacacacctgaagaagcccataaagcttactgtgaagctgctattaaactccacggagagtttgcaaaactaagttgacaaggtgctcagggaagagtaccttatactatatcttgtataggagggcttatgagccaccgtggaagaacccatgcagcaatgatgaaaggtgcttcaaaggaaactatcaagaaccgtaagcagaagttgtttgagagaatgaacaggttaattgacaattcatctctttcaggttctgagaaggttttcttgaaaggtaatctaaaaagcattgcacaagaacttattgacattgagtattggagacatcaaaaatgacacttgcagacgttattcagcaacttcacgacaattgctatactccagagttgattcaggagatgtccattgtagtgatgcctagtaagttcgtaaaaggttttaatggtgactctttaaagtctgcgcacattcttattgttgatggtaagattgcaagagaccgtactggagtactcaaaggtgaacgtattgatattctggagttgctatgaagaaaatgtacagtctctggggaagggttggtaaaggttttgactggacacttcttcgttcaaacgttaaacgtagtgaattaccagaactcatcactcactatttaaaaacatacagagaggtagactatcgtgaacaataaggttaagagttgtgtgaaagcaatggttgcacttggagtaatttttctggctggctgtaacccatcttatgaaaacaaagacgcctcttatagcctccctccagagatgcaagactgcaaaatctacaaactcaatggtgacgctataagtagggatattgttgttgtcagatgtccaaactctcaaacaacaacatcttatagctacggcaaaaatggtcaatcacatactacggttattgagtgaggttttcacgatggaagtcctagtaaactatatctaccgttatgatgttgttcactccactacaaccatagctcaacgtaatccaatcgtcccacgagaaggtgagctggttcgcattgatggttggacttacactgtggaaagcatcattcataagtttgatgttgctggtgatgttcaagttatcgacgtagagattggtggtaagagaaaatgactgtagaagataaatttaagaacgcagttcttacagaagatggtgagcttgaaaaattcattcttcgtgttgatggtaagctattccggtgtcgttgtgggtcaaactgtttccataaaccagataaaaatgacttagagctttacgcatgtaatgcttgcaatacttggtatcactcagaggttaaaaatgacaatcctatacaaacaaaataaagatggttccttcaacgtctggtcatgcgttgctgtaggtgacaaagttatcacaacctacggtaaagaaaatggcaagatgatgtttgaagagtacacagcagagcctaagaacatcggtaaaaagaatgagcgtaacgctgaacagcaagctctctttgaagtttctgctaagtacaagaaacaagtagaccgtaaaggttacgcttacacaaaagagtctgcacagaatactgagaaggtaggtgtacagcttgctcatgatgctgcaaaggttagccatgcaaagtatctgaagttccctgctgatgctcaaccaaaacttgatggtgtccgttgtagaatttcaagagatgctgattcagtcggtttcacagcttattctcgtgagaatactgtttacaacgttccagcagaactaattccagatttacttttgttgcttaaattacatccacaagttgaagactttgatggagagatttatgctcatggttgggacttagaagatattgtatctatgattaagaatgctgacaatccagaccgtcaccttcttaaattctactggtatgatatctgtgacaattcaaaatcttggcctgagcgtcgtgaagttattgataactcacccattgttgggcttggtgatacctgtagagtggttcctgtacagactatccgtgtaaattcttgggaagagtttgacgaagcccatgataagtgggttgaagctaagtttgaaggtgcaatgtaccgttcaatctctgaagactccttctatgagtgttgtcaccgttcatacttcttgattaagcacaagaagatgcacactgaagagtttaaagtgactggtgtcaagaccgataaacgtggtcatggtaagttcgttgtagagactcttcctaacgtctttgtagatgtctcatggaagactactcatgagaagaaacagtatcttgctgagcatcctgaagagtttatcgggaaacctttgacggttcagttccagaagatgactcgtaaggggtctttacagttccctgttgggctagttattcgagattacgaataaaaagttgttgacatagaaaatttggtgagtatactgagcagcatgaaccaacgggtactcaccagcatcacttaagagtcttctaagagggttttaagcgatgtattgcacggtaaggtgatgtgaagtctggtctggcatggcgtagtctggtatggaaggatggcagtagccttataaaaaatctgccaaataagctataaaatctgttgacaagtcaggtgttatagcttatttttatactcaatgtaatacaaaatttaatataactttgaggtcattatgaaaaagattttattagctgctgcaatggttatggcaatgaatttaccagtcaatgcaacagaacttccaaatgtggacttatcaggtgttccagaagacacttgccagattgttaaaggtcttgctctagctaatggtgagctactgaaaccaatctctgaagagtctttaacagagatgactgataaggtaactgactatcagtatcgcgttcttggagagtatttcctgcaatctgcaaatattaaagagaagcaccatgatgatattgatgtacaggctatgcgcaaccatcgtatccagtttaaagaagatttgatgcaaaaagctatgtatggtgttgagtatttcttagaaaacagaagctgcacaggtatttgatatggctcttaaaaagttacatcccagaagcggttatggtaagataattgatgatacagacggctttacagtctttacagttatctgtcaagatgattcacagattgaaaaggttcttgatgattatcttaacgatgaacgtgaaaaggttagggctacaaacatagattcattgattgacacttcacgcaaacggaagaagaaagatgaatgatgtttttgacccttatgccccacaagatgattgggaggctgatagagaggctgaaatggagagttatatttgtccaatggatgtagacgaaatgagagacttcgttgcacatcgttttaagagagagattaaatccagaggtctttctcaagaacaagttgctaaaatttgcggtatctctcaggctcgtgtatccaacataatccacctcactgggaatgtttcccttgagtatatgttgggagtgtgtgaaaaatttggtgttaatttcaatttaaggttggcagattaatatgaaacgtgaaaacattatccactttgaaaacttcgcattaggtttttatggcgtacctactcaccttgagaagtattatggtgtgaagattctttccaatctcattatggcttacaaagatggtaagattaagcatactgagaagaaacgtgtcatgggttatatggctgtaggttcagcaatctcaaacattaagctagaaacaactagcagtcagattgtgaaagaccacttcatcaaagagctttaccacaatcttgatggtgtagatgttcaggctgtttggctggatgttgatggtcacaactacacaagttttgtttttaaaaacgatgacatcaagtgtctgttcccataataggtgattaactatgattgatatctacttacaagatgctcatgcagatttccttaaagtgatgcttaaaaagtttatggcttcgcagcatgagaatgaagcatcttttaaaatagtcacatgtggcgacgaagctggttttgttgagattgaacatgaaggtactggaaagactgtttgtaagttacctgatagtatgttctctaaaacgttcttaacaaagactagtataaatgttaagcttgtaccacagattgaaacatactctggtacagattaccctaaaggtttcaagtcactaatgaagtatttcttagatgactttgtgagtaatcttctgagggaggtaaaagaaagtcgtacagtgttaactgtagagaacatgggaggaactatcagggtcacttctgactgttttgttatgagcctcttcgacttcattcctaagaactttgatggtattctggatgaagaagatgactgtgtagactttatattggttcttgagccagtttttgaggttaaatagatgaaaattgaacactgctatgagtctgatggaacacctattcgatgtccacattgtgggtgtacagacttgcaaggtgaagttcatgtgattgttaatggtcatatagctgaagagagtacgacatgtattgattgtggtgagcagctatcattctgggcttatggttcataccaacccacaccgcacttaatctaccatagcaataaagctgtgaagaatgttatcaactggttcattaagaaagggtttacaaaatgattaaattaatctttgcaagtggtgaaaatggagagtttggtactccaactggtatgccgtggcctcgacataaacaggatatgcaagagtttaagagactcactaaagataatttagtagtgatgggtaatgagacttttaagactctgggtagtaaacctttaccagaacgtacaaacctcatcttaacaaattctgtgccttattatggtatggacttcaccaaagatgatgttatatttgctaaggctcatcaagattcttttggagcatttttaaagtatcttgatagtaatattgaagaagacgtcttcgtaattggtggtgtaggtattcttgtcagtgctttaccgtatgctgatgtagtgttccatacagtttttcatgaagtgactgaagaggcaactgtgcatctaccttttgagaatttctttgataagttgcatgaccgtcaaattttcgctaagattcagtcaaaaccatcagtagatggtaaagcaacctttgaaatttatgttccacaagcaaaaggacacttttgatatgtcacaagcagattcaagttacaaaaatatcctgaaccatgttttatccgttggtgaactgcgtactacacgaactggagatgttatctctgcattcgctccaccacaatttcgttttgatatgcgtactggtttcccactcttaacatctaaacaggtgtttacacggcaagttattggggaagctttatggttcctgaacggtgagaataaacttggtgaactccgttaccgtacttggggtgaaaatgatggagaacgctggactatctggtcagatgattttaaacgctggttaagctctaattattcttctgaacaagattggttagaagatgcaggtgggagaatctacggggttcagtggagaaactttgaaggtcataatggttgtgttgtagaccagttagagaccttagtaacgaagatgaaaggtgatatcacagaccgctacatgcttgttaatgcttggaatgcagcagatattgcatccaactcgatggctttagcaccttgtcatgttctgtttcagatttatatcactaacgagggtgaagttgacttacaatggtatcaacgttctgtagacacctttttaggacttccgtttaacattgcatcttatggttttattctggaagtactttgcaagatgactgggtacactccacgatacttgataggtgtctttggggatactcagatttatcagaaccatatgaagcaggtttatgaattgatgaataatgaagagttccatgcaccaacttttgagattggtctaccacttaacacgctaagtgacctaaaacaccttactgcgagtgattttattggtggtattaacaactacaaacacgcagggaagattgaagcacctttgtcagtaggtaagtaaaacaaaaaggctcccgtaaaaaggagccttaaaattttattttcagtgttcttttgtgttcttctcagtaatagcttggagggctgatactgattgagccagattatttacactgtcagagaatttatcaagggttttggtaagttttgcgttttcacccttaacattctctaactgaactttctggttctccatccctagctgaaccagtctcatgtcagactgtaaatcacgaatagctgaatagttacttctggaataattatctagctgctgtaactttgttgtgacagacacttcttgcttaccacttgaaacttgcatcgtggtatacatcccaataacactaaaaataccaacaacaattgcaccaatattatttttaaaagcttcctctagccacttcatttatttctcccccttaaaagctttttctaagttatctacgaactcatcatcaataggtgtgtctgtcttacccgcaaggtatcttgcaagcttaaagaacactttctcaatcatgtattcacttagaagggataaaatgagtttccagaagaagctacctagattttttaggagaattgctaggattgtaggcatttaatcacctcatcagccaagatggtgagaatacccataaagaatattaacaccatcttaacaatcagtcaataagggattaagcagttcttacccaagccatcagcttatagaactggttagttacactaaatgctgaaccagaacctgtaccaccagtgttaccactaactgtatgactgtgagcaccaataccaactgtgtgagcatggtttccgttagaggcagcagtaccagatacagtgtgagagtggtcaccagctacactggaaacctgttctgtaccagatacctgaacacgcggtttaccaccgatagagtcaccaccataatgaccaccaactgtatgtgtatgagcaccagtgttgttagtagaaccactcactgagtgggtgtgagcaccagtagtgttagtggttttcgtaccatagtcaaatgatgaagtagtcgcagagaagctatgagtgtgtgaaggtaagttaccaacagataacgttacagaatctgaaccaccagttgtagcaacatctgaaccgtttgctgctgcaattctaatagttctaccaacaccattgttcagatacgtccaagttaacccagggagtgctgtattagggttaacattactgttaaaccatgtcacaatacctactggatagattttattcaggtctgtagagtcactaatcgcttctgcaatcttctggtcagtttctgatttagtatatgcaccaatatctgaaggtgttggcttcaagagactagtgtaatagtgagcaattgtcccatcaacatagccagatggagcgttgtcagatgtctctggagcctcaaacagttgtactgttgcattagatgttgactgaaccctagctgttgtagcgactagatagttaccaactgcgcaataaatgtcatagttatcaccagaggtattaacatacccaattctacttacatcattattcggtgagtttttccatgcaacaacatttaagccttttgggttaccatcccctgtcctaagaacaatttctgtcttacaggcttggtcaattaggccaaagttaaatccagccccaccaaacagttcaatcactgctgttgatgcgccttgtggcatattcacagttgcaatcttagcccatttaccagcaccactagtattgaaatctgtgcttcttactctcagatatctgttatcagcagatgatttgttgtagtatctcgcatcaatgttagaccaatctgaaggttgaacctgcccagtgattgctaaagttgcattcatttcgaatgttgagccaatggtaagcactttacctgttttgtagttaaacagccttaagttattattgttatcggcatcaccattaccaacataccacttagctgtcccatcagcagcccaccccctaatgaacaatgtcgtttcagtttttgcttttaacgcaagagcttcaccatcagagttgataacttgtcgtacagaaaatgtattgagagtattagttcttgcaattgtacttaatgttgctgccggaatatatctagagtcaatgttagtccaatcagatggttgaacttgaccattgatttgcaaggttttattaataccaacagtagtacctagtgaaacctgtgaacctgtaatgtagttataaatattcagacgtgtctcatcagaatctgtaccaacataccatttatttgttccatcagacttcttaccaagaatataaagtgctgtacctgcatcagtattctgcaaagtaatagcattagcattcttcttaacaacaaggttagtgaaagtattagcacctgtaaaagtgttattaacagctaactgtgcaaatctctgattagctgctgtctgagtaaagtatctagcatctaagttagagaagtcagaaggttgtacttgaccagtgattgctagagacttattcacagagatattgcttgcaatagtcaaagctgagtcatatttgttattgtacaactgcactgcatcagaaccatttttgctaataccaaccaaccatctagccgagccatctaggtctacaccttcaatatattgtgcattatttgcattttggtttctaaggcgaagtaagttaacatcaccttgaatgttctgagtcccagagaatgtgtttgtaacagcaagtcttgcatatcttgcgtcattctcttcattagttctcataccaagctcattaggacttggcttattcagagtatgataaacagttgctgaccttgaagcatctgcaatagttaatttaagaccatttgcgttaattttaaaagtctttaaaatatcccccatagtaatctcagaagagcctgtagggtcaaagactgccttaccaccataaagtaacttaacaatccctaagtcaccagtcatagtgctaccagcaatctgaacaaatctttcaagcttaaaagatgctaagaagtcttgataggtcattcgacggtcttcatcacccagcatttcaggtctctttttaaccctgacatgaagaaggtcgtctgaacggattgtatcgattgagtttaattcactcaatttgtaatctgccattatttttgtcctctagaaagagggctgtacagccccctgtaaaagaatttttaagcggttctttgccatacataaaccacaaaggatggttgttcaacgctgaatgcttgaccagcacctgtagtacctgtagtacctgagtgagtatgctcagatgactgcaaagttactgtgcctttatgggtatgagcaccaattgcaacagtatgcgtgtgagcaccaattgcaacagtgtgttggtgattgcctgtggtatttgttgaaccgctaatagtgtgtgagtggtcaccagctacactggaaacctgttctgtaccagatacctgaacacgcggtttaccaccgatagagtcaccaccataacgaccacctacagtatgtgtgtgattacctgtggtatttgttgaaccactcactgagtgggtgtgagcaccagtgctattagtggtctttgttccataatcgaaactgtttgtgctcttattgccgtaatcaaagccatcaatagtaatagcagcaccatgagtgtgtccaccaccagttaggtagattgaatggctatgtgatggtaggttgttactagataagctaacactacttgagccaaagttactaccaactggcctagaatcactatcataacctacaagtgctcttcctcttgaaactaactcccaagtacctccacaaattaaatatgtagaagggtttgcaggattcatagagagatggatagtacctactggataagaagcctgaacagccttgtacaagttatttactgctcttgctgtagcatacttatctgcatcctcattataaaggttagatgtcacccagttctggacattgctcaaaccaacctgtgccttagttgtattgtgtgggttacttttatcattaatatgctgttgaacaaggctattaacctcttctgaagacataatctgtagatttgctcttgcctcagtgacattagcaacatctgataagttatttgcagcaactaactgaagagcattgataacattatctaaaccaatttgtgttttagtaacaccgtgagggttatttcttaggcttgagtgtggagcaagtaattgctcaagagtacatctcttatcctcaataccctgcttaagatggaagatatcactaaggtcaattggtaaggctgcttgaggcaaggcactaatttgaatttcacctactgccattattaagctcctacaaattcataagtgtaaaggttttttgtacttgttgatgcagtacctgtttcggtcttaataagactccagccattagctactaaatctggttgctcagtggcaaaagaccttacttcaccaacagttccgtttgctttcttcaggagatagtttaagatatagttaaaccattggcgtcccataggctcaccccttaataaaccagtggcctgaatttctggtggtggtaatacttttagctggttaccatcagcatctacttcatctgtagaccaatttaaaaatgccattaagaacttccttcttgctgtgatttatcttttctacctttgatgatttgagctacttcagccataacaccataatcaccacctgctgcagtttctttaccaacgatgtagttatctgtagcgttataatttttattaacttttaagtaatctactgagccactattagccgtcctatcaacctcgaaataagcatctcttacgccagcatctgtcaagctacctagtaagttcttatctaaagaaccacctgtgttgttagtaacaagacccttgttagcatctgtaacgaaccagttatctttatcatcaacaattgctaaggctgagtcagccacctctacaggtgtccaagcagtaccattcagagttacgtctcttagaataactgctgagccaatagttgttgcagcaatttttgctaatgtgtacgctgtatcaatgacgttatttcttgtattaaccctgactacaataccagcagtcacaggtgtaatatgctcaaaaatctgtgaaaatgttgcgttatacagagtcatgatagcattctgtaaaaacgttggagttgtgtcagaacgtcttagaaaaatttggatatacagcattgctctgtatgtttcatcatcagcaccaagtggtcgtggcactttaattaatgaaccaatgttgtctaattgctgcccaacagcttttctgatattcctttcagtgtgcatttgccatgaaacatcttccaatgtctgcaactcatcagtaatcgctttaagtaagcttgtgtagatgaacttatctttaaactgtgttacagtcctttcatcaagagtcttatagtaaacgttatcaattttctgaaacattattactccttagcaatggtgtactgactactttcccatacagtatattggtcaccatcaacagtaattcttgccgtagtatactgcccatcactaggaggtactgattggttatttgaaagagctactttgatttcattaatctcaacacctttaatgacatcataaatatacccatagattctgttagggataacatcattaccaactttcaaagttctaccgtaagcgttaataccttgaacaatactatctctgatatcttcttctgggattgttaagctctcttcatcatataaagaataagatactttgacaaaagcatacttgggtgttggtctgctaaaatagacattatgagctaagttacctaagtcataagctgtaccaaagatagctccataagccctgataccagcaggtttggtgtcccagattgcttgagcaacattatcattttgaccaccaactacaacaatcttgaaagactttggtggaagcccttctgaacttgtctcttcagtatcattttccacacctgaagcatctgatacaccctgaactcttttaacagcagctacgattgcatcaagagtacctacaccagtaactgccaaagattctaaatatctctgtcgaagttctgtatcagtttcttcatttctacctgttgtcaggtcatatctgttgtatacactgtcaagaccatctacagttgtttcaatttcgataagtgttccagctaatgcagggattgcaccaacttcctcagcaacaacatcattgatagttgtaatttttgtgaatgtaaggaacgtcgtagcagtcaccaccatagggttggttctggcaataatgtcaccttcatctttataaactcgtaatgctgaaccgtcattgataacttcggcttttgctacgataccaccattgattgcatcggcaagttcagttaatagtactgtgattgtatctgaagattttggctgataagagaaaataacgttatcaataataataacataatctgcatcagttcgtaaagagttaacttcaagaacagcttcaacacaatatgaaggtgttaatgtaatgtttgaaactggatagaagatattaccagcagtgcttcttagtctagttgtagatggaattgttgcaccagttgttccagtaaactctacttggcctcttgtagcctgagccacatatctgtatacggcgtttaaagctgtaatatcatcgaggttaaaaccttccgctttatcaatcgtcccaccatcataaatttctgacaggacttcatgggtgtctgctaaagaccttgcaattgaagccagaaagagacctaattgactatcttcagaaacgtcaaggtttggtgaaatatctctaagaagtcttgatttaatattatcaaaaatttcctgatatcttagagtttgtaatcctgttgtagttaatcctgccattagatattaacctcttgcgtaatgtctgttaaaatatctgttgtagtagttgcatcaaaattaacagttacttttctttgagcattgtccattgaagacgagtagttatagatattggatacatctcttgtttcaacaaggtaagctttcatataattatcaaagatagaagttttctgtttaaatttggcaagttgtaaatatgggaatccagcagatgtgttaaagaagacttcaccagcccttaaaaggcatctgatatgaagtctttgagcaacctgagtagctttatcatcttctgggataattctaatttggttaccagtaatctttaaatcaccatgagccacatacactgaatctgaacctaaagtggcaacatagtcaccacctagatttaatgcaaaatctgttttcattattgtgcctctgtagtatcagcctcaccagcagggtctgtccagtaataatggtgcgtgtgttcattaaagctcacaccagtcgtgtcactgataaaatctgaaccatgtacttcttctgttacgtacaagtttttagaaatgtgtacatcaccttcaaaataaaaattgccatcatctgtaactcttaacacagagtcaccgaaatgaagtctgactgctgttgggtctggtttaaaattctgtgttcttgtgcagatgcctacgaaagctacacagtctgagatatcgtgtgtccttctcatatttgtttccatctgagtattcttgtcattgacaacgaagtcatctaaaggtaacattgagaaagctagccagcatctgtcattagtttttacagggaatgttaaagatgcgccaccaccacttggaaattgaacaggaacaccagtaatctctggcataggtaaaccgttaatagagtaaagtggcttaacagtggctgtttgagtctttgaatcaaaagactggataatagctggtaagccagtatacagttcttttctaaattcatcaagacattctgaaacatacccagacattctagtaactggtgacttcattattccaccttctctaaatctagttcagttgtccaagcaccaccagtaaagtcaagattatgagaaagaccttttactcgatactgaccttcaaaatcttcactttctctaattgtgacactatcacccatcttaattctcccgtctaaatggattttgcaacgaactccagttttaactttaataactgtcttattctcttttttcagaacctttctagttcttctgtagtaaccttgcaaagaatcaataacattatacgggtaaatttcccaagaaagttgtctagccttagcgttaaaagggactactctgatttgcttgttaaatgtataccaacgtagactactttcttcacaaacctttgtaagtgcctctgcaacacttccccaaacactaaaaccattcttgtaagtgtaaccatcaatacttgaaaggtcttcatcaataagtgagaagcctaatctattgactaaatctctaattacactcttacgtgttgtacctgctttataagagattgatgtcttaatcgtggttctttccattttatcattggaacagatgacctttgtaaccatatcaacaccacgcttatatgtataagcatattcaatagttcctagataaattaatgggaggttgtcatactcaataataaggtcaccatttgcgtctcttttaaagccagtggtgtaacctgctctgagcataactgttgcaccaactgttttaaatttggctctcatctctttatttaggttgtagatttcaaaagtggtgtcatcggaggttactttatttttctgagacgtataagacacgttacaagtgaattgtaagttgtcgaaatagtccatttgcatagaatctttggcatggcttgtaggtttatcattaaaggctgtagtttcactacctacagccaattgatagcacctaaaagaagccccagcagtgctatcttttacagacattataaattctccattaatctcatatcttcttgagtgtaataattaagctcaaatgccctttctcttccgaaattatttctggtaggttgtaaatcagtaccatacattcgttcaacaaaaagctctccagctaatgaaggaattacatagcgtcctgtgattgactggtctgcaaggcatttcttttcagataataatacattaccatcaacatcagatagcgtcaagaaccatctgtcaagcctctctttatactttaactcaattataaagacagtaccatccagagttacagtttgtgtagaccactctgtatcaggaacaggaatatattgtgacattaataagtccccttcttattcggattcactgaatgcttttgtaatgcctttccagttccagcagtattatttaacgctgctccagcatttctttcagcctcgtcactaaatgtggtgacaccttttcttgtcttcgcagacattgagcatttcccaagcgcattaccttcagcactagtgagttcccttacaccattagcatctaggtcaaatagtagctgacagtttaatttaccattacctaaacttgtcgtagtgttccctgtattctttttactggtagcaccaccatcattcgtggtagcggtctttccagtagctgctgaaacatcagtttgccctacaatagctttaaagttaatttcctgaaaagttagctggattctcagaccatttgaaataccaacatctttagaggctttaaaacttgtaataatggaatcatcaattttaataccatctttacagatgactgaaataatctgcttctggtcacgccagttttccagagtgtcaatgaagttttctactaattgaccctgacgagttaataataagctcccttcatagccaactacaacgacaccactgatagtgattgttctgggtgctctctgcacattatctgtgacagtttgccctgattgcatgttctgtgtagtcacctgcatagggctgtcaaattccatgttttcagtagctgataaggttaagaaggcatctacattatctcttaagtggaaatagatgccatctttgccactatatttgatttgcatattagaatcccataacattattcttcctctggatagcttgaacttagaagaatgtcttcttgattcttgtcagtaatatccaccatcttagtagcaatttgtttaccatcaagattgaaagtaacattcagggtttgtttagtctgcataggtaaaccagaaggtgtcatcatcattggtgtctggttaaacttattggcaaaattatcaatggatgttgatagcttctccatgataatctcccaattagataggccattgtcaattaactttctgttgccttcaacatcttgagtgtactgtgcaaactgaagttgaccattctcatcaaagaacattggtctttttgggtttgtaatatttgcaacagcattttcaaatggttttggtaatgtaacttcactgtagtttttagcagcatttgggtctgtagaacctcttagcattaatgccgaaccaacagtaccaagtgccattctcgttgctgtaactccacctgctgctgcggctgcttctccggctgctgctgtacctgctgcactaacaccaagtctttgtaagattttaccaaagataccaccaccaaccaaaccacttaggagcttgactgattttgatactacagcaactgcaccaccaattgtcacaactgttcccagaaattcaccagcacttttgataagtttttgctggctgttgtcaaggtctttataccaagctcttgcatagtagtatagtgcagatgttctgtacatgaagtctgtaacgaagtcaagtagattactagcaccttttaagagactcccaatcacaagacccaaagcttgtgtgctacccatagaaccttgtaagaacattgcaacagagttagataactgtgaaataccctcactagagttgttaaacagtgctacaagtgtgttatcccacattgccttagcttgacccattgatgtagcggtctgcttagatacagcgttcataccacctgcttgcttgacaagttcagccattctttcagatactttaggaagaacgtcttgagcaagcagtttaccatcttgcatcatcttatcaagttcttgtggggtcttaccaatggcatcagcgaatagctgtacagcacctgctaaacggtcacctaactgtccacggagttcttcagcctgaactttaccttttgatgccatctgctggaatgcaaccatgatacctttcaagtcttcatcagtagcacccctgatacgggcaaacattgcagcattcttatagaactcttgagtaccttgaaaaccaagtgttggttgagcaccagcagcaaagtttgagtactgcttcatagtgtctgtgtagttctgaccaatctggtgtgcgaatgatgcagcgaacattctagcttgctgtgtatctgctccaaagatagctgtagaggctaactgtgcagattgtctttttacaccagcttcaatagtcttttgagatagttccagtaaagcgtaagctgaaacaaatccaccaactaattggcgtaatgatgcgttagctctatcctgtagccaagctgattctttaactgattttaatctagcattttctgcaataacccaacgtttggttacgtcgatgagctttttaacttccatctcatactcaccaaccttaccagtccctttgtatctgttgtagatattttgcaagctccctctgaaagaggctgccatctggttaccttgaccaccaattgtttccagtctacgggttaaccctgaatagaagttgttattaaacatcctttccatttgtctctgagcaacatctactctctgacctctgggtgctccaccaccaacaggggggatgctctgtccacctctccctctgcctgttttaatagtgattttaccgtcaacattcatagcatctcttaaggacttgttaataccttttgcagtcttttttgcttgagtttcaagtttcttaagagatttaacaccttgtgaatcaaggttcaaggaactgttgagtgctttattgattctgcccgaagcagactgagcattttttacaattctattaagtgcttcctgagagcttttattaggtttcacatcaaaggctttattaatatttctctcaatacgttgagcagcttgcatagacatcttctcaactctttgcaagcccttaataaccttttcactgaaaccaagttccacaatgaagctatcaactgtatattgtgccattacatttttcctgctcttctaagttcgttgtaagcaatttcctctttatacgacctctgaatttcaagaaattgtctcaatgataataaatcagagaatgtcatagcaaagagttggtcaagtgtttctttacacccttccataccataaatagcaagcacaaatttcatctcgtctgcttcttcataggttgcctctacagcagcatcagttagtggtgtctgtagagtgttgcccatgtttactgagaagttaggcttttgaaaatgcttgcttcgaaaaaacttccgaagtttgcctccagcgcaaatgctaagtaatcaatgaactcaccatagtttgcttggaagtacgtatcaatattaagtgggaagtcatcaacagttgccccttgaaataacagagttgccatttcttcaaggttaatctcttcaattctgtcaaaacaagcttcaacaagttctttaaatggaaccattggagcttccttcttatccttgtcagtcagacttgatagcatctgtgcaaaggttggaacaacaattttacccaacttcatagacatcttaataccatctcttgccccaagcagaacgatatttactttcttaccattaattactctaaattctgttttcattgtgattccttaatacttttaaaagaaacaaaaaaggggaagaccttttaaagtctcccccttataggatttattaaacacttgacgctggaattgtagaagtatagtctagcttctcacaaccaaaaatccaagttttagagttctggtcacgaccaagttcaatctgtggcaactcctgcaaccaagcattaataccagttgccagaacagagcctgatgggtcgtagattacgaagttagaagagatatctacttcaagttccatattgtcttgtttagcttgaattgcagaaagcatctggttagagagagaagtctgcattagctcaatctcaatagtacctgtcttgtctgcatttcttgtcagagcaacctgaccacctgcaccaacaactggtgtcacaagtggtgatgttctctgtagacgcaagaatgagtctggggcaaagccttcaatggcaataccattccagctacatacaacgtctttaggggaatattgctgatacatagccattccaatttacctctattattcgtaagccactgtacctttcaagtcaacatccaagatagcccctgctaagatacctgcgaaggtaacatctttcaggatacgagctttcttgtctgctaaagcaacttgagaggctttaggaacattaactgtgtaagatgacaggaagtttctgttgactgctctttgcagagaggtttcaatgacttgacgaatacgggtaataccagtatcatcataagtaatcttaccacccttctggttaattagcaagtctctcagagaagttttcaggtctgattctaaccagtcaacaccacggacgatatcaatccattccccaccagaagtaatccctctacgaaccactggaacaccaccatcaaggtcaataaagttacagtgacgtacatctaaagcagacttctgaatacttgtcagaggtctctgattagatggttgtagagaagctgctacaccagttagctgagcattaccccaagcaattgaacctgcatcatatggagcaccataagcaatgtatgccatctctgggtaatcttctgctgctgcgtgatgccacaagcaaactgtacgagtgtacatattcttagcaagctgtgctggaacatcatttgcactggctaattctgtaccttgcagggctgttacatcggagttagctgtaaagaagattttcttgcgagcctgaatctcagaagccattgctaagacaaactgttgagttctgtcttctgctgcaatgaaataccagtcagtagaataagcttcaatggctgccagagcagttgctgctgtatcggcagttgtacttgcaatatatacagtctgtgctgtggttgttactttcacaaagtcattatcaccagctttggtaataatcattgtggcagagccattgctaccagttacattcacagaaaccttatctttgattgttgggtcagcttcaatctgtgttttaaactgttgtaacactacctcagcagtgtctgaactttgtgctgtgtactggtatggttgagaaattccaccgccagcagctacagtaattgagtagtctgtactttcggtaacggcatcaggaattgatacagtgtactgcatagcgcgtctaccgatataaagctgagttactttaggagtctgactccaaagttgtttagcagctttatatgcagcagtattttcatcgaaatcttcagcaacttcagttaaggaagtgtaaccacgcactctttcttcaaagttatctgttgaagctaagaatagtggcaaaccaaaaccttctcttgtagttcctgcggtgttcaatgtaatatctacattaacaattggattccacatttattttacccctttggagtctacatctagatggatagtatattctggtggctcttgtccttcttcataaaccaactcaccatcaacaatgacacgctcaataatacttccacgttcatccttcaggactgagttttttacaagagttacaacaagaggcgcagaattttcgaaatctgtattgagataagtatagtcattcgggatagctccagtgtctagtactgtagctcctgtctcttcaaggattaaatctctgactgaactcatctctaatcgttgtttaagctcaagcataatactgtgagcacctttaccattcaccgtaattaatactggaatctgaaaagcaattctgtagcaaactacatcatcctcaacaaacttatcaagaacccaaccataaggtgttgcagcatcttgacagtatacggtaataaatggctggtcaggttttaaacctttgtcatttgagttatcagaagggtaagctctaattacattcggtctattatttttatcacgagccagtctgtgaccaataacatccactaaggttctaactagacctttttcaagttctgctgtttctaactgcattcattttatcccttctaataatgatatattcataatgggacgtatgggctaattgctgtgaccaatccatagtcataaatacttcatactcatgaccatcaatcataacaatatcagactcattccactctacatcatctgaagttctaagtttatatgtagtatacaggattcttgtatcggtaagtctgataccttccggtaaagcaatctgtgtaccattctttacagaacctttgatatatggctggatattacctttacagttaacctctacaatatcttgtgaagctacccaatcaccatcatcattgtaataaccgtcttcagagactttacgctttactacaaagctgtgtctgtttaagagtctcatttcttaatacccttcttagtagaaattttataagcaaggttatctcttaagtcacctgtctcaacaagaggtgcattaaagccttttttcttgactgtggaaggtgcgttaggagggaggatagcagaattaccaaagccccttttaattgccttttgagcattctttgcaaatgcttctaaggtatttgaagggtctgtgttgagactgctaagttgcttatatagattcttcttagtctgctctaacaaggtctgtttgtttagcatcatagtgatttcaaacaacctacgatacactttaccagaagctgaaggaaccccaataacttcttgcaaatacattaaagcaggataagaaaaaccagagctatgttgaccttgttcttgaaaatacccaacttgagcattagccgtttgcaagttcttcatagccccgactaattttgctctagcggggtgaataacccttttaaccattattcatctcgctcgataataaatacgccattaacacggttgcagtaatctctgccttcgtatctggcagcatcaccatattctgtgtatttcttgacagagcaaggattctgacgacgcatgtcaatatcacactgattaataccacctgcatagggtagtcctgaaacagagcttttaacaaggtcatcataaacagctttcagagatttgaatctggaagagttacgtaaataaacaccaccaaccttctcatctcccatcttggctacttgaaagagtaaatatttaagagctttgatggctgctttcttttcatcctttccagattctagatagaaccactctagcacagactgctcaataagaatttcatcattattagtgtctgtgcagaggattcttactctatcaagagggttattggctgggtcgcctgtataacacattcataaccctcctaagtttattagctacctttagcgtcagcgcgaacatctaccagcaactgaggacgagtgcagtatggcagcatgtaagagtgagcttcgaagtcaataccttcgtcacggtctttttcgtattcgaatacgtacagttcctgaccaagtgtatttgcgtaacccatcttaggacatgggccatatgccacttcgaagatgttgttagcttcacccagcatagatacgttagggaaggcatgaccaacaccaacagttgctgctacactatcaatgctcaccagagtgtgaaccttaccacgcttgtctttgaacttaccgttgtactggacaaacttaacaccaccgtagtagaaggtgttcatatgagcctgaacgccgtcagtaccaccagttctcagagaaccagtaatctgttgccaagccagtggagtctgctgtgcaagataagcgtcacgaatcttaggatgcttaaccagtttgctgaagaatacacggtcaacaactacgtgaatttcttcaccgttgattacagtgccagtcttagcttcgtcttccatgtgcatacgcagttcttcgatagaagcgtcgatgtcagcattagggttgtcaaggtcgaagtaaatagtcttcttctcaacgtcgaactgcttgtacaggtcagcatacagagtaccacgagcatcaacaactttacccttcagagcttgcataaacaggaactcacgagtaatatcgaacttggtacgaatcttcatcagcttcttagcacgtactacagcttcagtagtcagttcatttgcagtgcctggctgacgtacaccctgaatctcatcaggagtaatgctttcaacttctttgaagtacatcattgggaagctgatttgacgaacacgctcaggtgcgctagtctctgctttacggctatcacggtctaccgcatcaagcaagctaacatcccaatcagtcaagtccatcaggaaagtagtttgggtgattggtgctgaacggaacagacctaagttggaaatatacccataagtatttgggatagactggacttcaccagtcaggtcagcaaggaaaaatctgcttttttcagaattagtcaacattgtaaaattctccagaatgtcttattattgttattacaggccagttggtacgaaatcaatacctttggcagccagagctttcttgactgcggcagcgtcaacgcttgcttcaagagtcagcatgtctttcagttctgcatcacggtggataccaacaactttcaactgaccatgataagacagttgcaggtctgcataaaagttaacgatacatactgaatcagcctgagcttcttgccctgctgtaaccttagtaccatctgctttcagaacttcacctacacggtattctgttgaagcaaccggagtgtactctttgcgagagtgacctgttggggtaacctgttcccaaagaatgatatcattcagaggttctctgttacctaacttagtaaaaccttgatatgccattattgtgttccttatttgataagagattttagagcattctggagagccagtttgcgttgttcagcggtgtcttcggaagcattcttagctggttctttttcttcttcaaccaaatcagcttcgccgtcattacccacttcttccatagcattggaatgttcaagaacagcaccagcagtttctttcagcttggtaatttctgattctttttcttccattgcagaagcatgggacgcgatagtttcattaagtttctggttagcaccttccatagcattcataaacagaacactcagagggttatcaagaccagcacctaaaatagtcgttgcagcttcttttgcatcaaatccaaaagcttcagcagaagcagaaatcttattagtcaaatctgacaaagcagcttcctgttctttagctttcatttgagcaacctgaagacgcaaagcttctagttcttgcttttcttgttcagtcatttcttcacctgaattgttaacgtttaaacttacaggagcctcttcagaaccttgtaagtaatttaagaaatcatcttgagacatgattgagttaattaaaccaagttcaagagcttcctgagcagaataaacattcgcctcagtattctttacagcttcttcagagagattacgagattcagctacaaaacctgtaaaggttgcgtaggtatcattaattctcttttgaagtctttctttgctttcttctgaaagtgcttggaatggtgaacccatacctttaaactcaccagctttgatgacgttaattgttacgccattcttttcaaatgctttagttaattcctgatgaaccataattacaccaatagaaccaacatctgcatctggtgatgcaataatttcttcagcagaagatgcaagagcgtatgcagcggaacaagcgaactcatctacataagcaataattttcttttggcctcttgaagccataatgtgacgtgctaattcaaagcaacctgaagcttcaccaccaccagaatcgatgtgcagaacaatagtcttaattgactcatctgctaaagcttcgtcaaagcctctacgtaaaccctcataagagcttaatccacctgtacacattgcatcaatgaatgtcatacgatgggttaaaccacccataatagggataatagcaatgtcatcttttacttttaaaagacttcttgcttcacctttgggtttatcaaagtttactgctgcttggacatcacccagcaatctgttattcacataagttgctgctgagtgagctaatgattcagtggctagtaaaggttggttgaataatctatcagcaagtctgaagatattcgaactcatttttactcaccctatttgtttaaatctacagagactgaagagataacatagataccttcttcagcaaagaattgaggtttgctaagagcaccagttgccacgcatttatcgttagcatcccacaagctatagtgtgagaccgttgcagaagctgggacagtaatgttaactgtgtcttctgaggcaattaagccattatccggttcagaaaaataaatagccactggctgagtaaccttatttgctgtagggtctgccgttgggtctacattgtgtaaaataatagtcgttggggttagcgtggcgaggattttattcttaccatcaatagttaatgttcccattaattaaaccttactttttgtttaaggactgttgaatggttaccagattcatctaccacatttacaatcatatcatatactttgcctttgacaagtactttgtaatcattttgtgaaaaaatgtattcaagtctgtttgtttctttattaactgtcattggagattgaaatgcagtgtcgagggtaatgaaagcggcttcaatgctattaacattgatacgtttattctcgcagttatataactttacacccaaaaggcatgaactgtcaaatggaattttaacaatttcactacaatttcctgaaataaacggttttccactcattggagcatcaagtaacctgcaaatagtgaaaacgtcagaggctccaccatcgcttacataacctgaaaggctgacccttgagccagcctctacagataacttgtcagtaatgataagaacacctctatacgaatgcacccgtgtagcatttgaaatagagataacttcagccattatttatttgccttatttgctgtgcttgggtcttttgctgaaggtgtctttgcagtaccttctccagcagtcttatagccatctcctgaacggctttggctatttggagaaagcttttcagatactggttgagactcatcagcaggaggaagaccaatatgctctctaagcttgttagatagctctttgtcaacttccaaagcacctactgcaacagtcttctgaatataagaaccaattgcttcaaggtctggagtttcgatatcatcatatgtgatttgcacatgttcttcatcatcccacatattaagagcgtaagtctgtgcaactaaatcacggttaattacgttcttaatttgcttcagcaggatatctactgacatcgctaataagcttgtcttagaatctgcaagagagaatgaaccgtattttgactgacccatagcaagaacatctgacataaatgccatcataatctgcttggaatatctgtcgataatagaacctgtatcgtatgctttagcaccctgtctagaaactaatgagaactcaaaaatatcctctttagtatctgggtcgatatatctaggccagattaaacctgctctatcattagcaatcatatcgttaacaacagttttgcagtattgtacgaaagctttcttttcaggttctgcattttcatccagataatctggtggtaaaccaatctttggcatacctaccaagtctcttgaaacaccaacggcttcgtactcttcaatctgaactttatacttccacggtacataggcattaagtaatggtgaacgaccttctgggtttccatattcatcatcatacttaaacagcatgaatttagctcgtgggagttttcttgttagtggcctttctccgagattaattgctccagcaatatgtgaaacatttctcagattctgcctaacaccagtaacttttctaaagtcttcgtcaaaataccacttatcaagtgttgactggtttctgattggtaatttagcccatccaattagaccatcatcaaattttgactggtactttcctttcttaccctgacgcttcttataaactttctcgttaacacagaacccataagtgcagaatgacattacagagttaataaaatctgcccaatcatgctccatgtcatccattaaagaattaaagaagtctgctctttcaagcattttagggtcttgctcttttccctttggaggtacaaatctccagttgacttttctgacaaacatcttaataatatttacagatgctgctacagcagggtcacgcatcattaattggaaagttttaatactttcagggaaccttagtgcctgacgaggttcttcatagattcttccattcttaaccttcagacccaaagaacctacttcacccattctaaatggtggtaagctttcttgtgtttctgtaatatctgccattcttctcacctagctatcaacgtctaagcccctcatatgggtttcctctcactaagtctgtgtgagcacccattgatggtggcttgaataatttaacttcgttaagactgttgaaagcatcactggtagcatccacttggtcatctttagttttgccatcaccacaaaagccttcaagctcttggaaataagcttcgttccaactacctctcaaaacttttacaagtccagcttcagaagcagcagaaaatcccgcaaagcgggtaactttatctttatttgttggtttagctcttgcacgatagcctttctcggcaagtttcctgatgagggatgtcgcgtaggatttaccagcagcgcctgggtcttgagggataaaaataccagttcgcttaccgtcactttcagcagtcaaattaatttgtgtttcgactccagagggtctatctctaaatcttactacatcaatgatataatagcaaccgtcttttttagatttacccatcttaacacctgctgtccagtctggattagggttaatctcagatggtaaagttgctgctaagtcccatgctctaacatcaaatacatcttctgggagtgaatcaacaatttcacaccattgtctttgccaatagtttgaaccttctgcacgagccttccagttaccgaaacgaagtcttgcaacgttcacaggagtgttgttttcaagcttaccgcgatactttggttctaagaagtcaaggattgggttatcatcaatcgtaccagagataaaggtgtatgtttgaggaatctcaagagggaacatttcaagaatcttgtctctctcccaatcagaaaccatcacaccatcattcattacataccaacgaatacgaccacacttttcagggtctggataacctccttcatctaagaatggctctacccaatcataaataaagtggtctctgtctgggttcatggaaatcttcatgtatgaatcaccttcagcaccagaacgtagacgggtttgtaggtatgaaatctgtgaagcagagaagtgtgtaccttcgtcaaagtaaatagctgagtattcaataccctgatgaccttcagcgtgcttttcaagttctagataggtaaacttgatagtcgccccagaagggaatgtgatagtcattttctgctcgtgaggaatcccaccaaacttaccaaatagtttctttgcagcaggccataaaccaccttgtaactgtgttgtgtttcgacggaaatacacagcattatagttagggtcttcaataaatcttaaagagtccattaacaatgcagcagtcttaccagcaccagcagcaccaccatagagaaccaagtcagcattagtgtttaaaaagacctcttgagaacccggctgaggggctacatagttcttatcagtcatcaatttaaagataaggcgaacttggtctggtgtgtatcttaataaagtcagaatttgagttggaaggaatttagaggggtctttaccgaatgatttgataatttcttttacttcatcagaaagccccaactctccagctaggactttcctaacatcttccactcgcttctgcttaacagcatttaagtccattaagcgcctccgcaaatagaattattcagagtctgtcgcagtctcttctttcttaacttcgaactttgcatcaacagcatcaagaagtgcatccatagatgcttctttaatatcaatgcctgttgctacagataatctgtctgcaattgccatgatagtattctgcataaactctaacttcttgttagcttcataaagttctttataaacgttctcgctcattatgttttctccaaataataaatcttgtttccccttaaaaaagacggcacagagaccgtcaaggagaaaccacaatgtacgtcagagacatactgtataagtcttcctataaagtataactctgtaaaaaagccctgtctaaaaatactcttcggtagcgaaaggaagaatacttatagcagggcattattattattttaattgagagagagtaaaataacttggagaatccgaagggacttgaacccttataaacctgttttgcagacaggcacatatccatttctgtcacggattcagattggaggaagataccagacttgaactggtacaccgatttctcagctactggcagtttagcaaactgctcccttaccttttagggttaatcttccattatttctgtaatgcgttcttcatttctggtgttgcaatagtgtcgattacaccagttttgcgagcatcatcaaaccagtctggtaagatacctgctaagaacccattgatattcgttttaaggtactctgcaataagggcagcttcttcttcaatcatctgcacaacttcatctgcataagctgtaatctttgagataccttcattaatcttgctaacagcttgattagctaaatcagaaacagtatcaagacccttatcaatagcgtcttgtaagtcacttaacacaccgttaacactgtctagtgtgctgttaatcatgtcaatagctttttgaccatactctgtagcaacacccataataccactgaatggtgtacaaccaacttgttctcctgctgcacccataacattggaatacccctttgctacctgcatacgtgatgaaaactcatcaatagacttttgaccatagtctgttagggtcttagtagttgctgtagtgcttgtcaggcttgttgtaaagctgtttagaaggactgttgtaagtccagcagcaacaagtttctcattcattgtcgggtctgttacagagctaatagagcttacaagtgatgtagaggcagctacggttccaccgagaactgctgcaccagtaataagtgggttagaaaaccctttaccggtttttaagagattaaaaatctccttaccttgtcctgtcatctctttcattaagcacctttgaaattggtagtccagtgggatttgaaccctcttctcatgtttttcagacacgcgctttaaccatataagctacttggactataaattggggtgacctacgggatttgaacccgtatagaccatgttcacagcatgggtcattaccgtttatgataaggccacatttaaggactctcgtaagaacccttagaagtggcagcggcataaggatttgaaccttaataggacagcttcagagactgctgcattgccagttatgctataccgctaaaattggtactccatatcggattcgaaccgatacataacacagattttaagtctggcctctctgccaattggagtaatggagcattggcgggggatgttggaattgaaccaacttcttcgatttcaaagaccgaggttttaaccttgtaaactaatcccctttaaatctttactttctcagtggatgaataaagaatgccaacataactctttcccttgagaatgctctttcttctgggacaacactttttagtttccatccaacataaattctccagtaaaactgtttaccaaagactttaattgacggaataaaagcgaataatccccaagcattgttgttccacattaggagataaccagtctgattatcttcagggtcagaacttacgttgatattacctctccacttagtaacatcttttacatctcttcctaatacatggtaagagaagttataagctttgtttctccagagccacccaactctctgcatgtagacacccagcttaccaatctttctaatcttagcccatcttttaacgtgaccttcgtcaccatcaatcgggttgtcataggtctccatccatctgaatccaaaaggtagatgtcctttcttctcactgtagaatggaactacgaaaggtgctaagataactgctaggattgctgcaattgggtctagtaaagctaagaaaatccatgaagcatacttcaaatatctcattaaatagcctctttaaattggtgttccaagacggattcgaaccgtcactaatacaaggtttgagcttgcatcctctgccaattgggatactggaacatggtactcactaaaggacttgaacctttttcttcatcttgtaagggtgatgttttaccatataaactaagcgagtgtgaaagaggtctgaagttgtgccgctaactcaactccgtggaatttgttacggtcttcagttgacaccagcggtctttcacttgacctctgaattggtgctgctcacaggactcgaacctgcatttccatccttacaagggatgtgtaatagccaattatacgaaagcagcattgtttggagcatccagagggaatcgaaccctcaacctcagtttggaagactgtaattttcccgtttaaactatggatgcactaattggtggagtcactgagaattgaactcagttcccaagtttgcaaaactcgaattttaaccatataaactatgacccaaatgtctggtacaggtggagggaattgaacccatcgtcttactgattaagagtcagccgcataaccattttgctacacctgcattaatttggtaggagacaagggattcgaaccctcaaacaccaacttctaaggatggtaggtttaccaattaccgtcaatctcccattaaatctttttagagaacttctaagaacctaagcaacaaggttccacaacaagcggtaataaccttagaagccctctaaaaagacctaaaaaggtctttgcatagtcttgtttaatccggtgactagaacctttggagagcttgatattatctcttctccgtgacacctactaggtgttttatcagtgtgtacgacaatacacgagggataccaaagcaacatccgaatgaagcttggctttaaaatcttattaggcggtaagtaaaggagtcgaaccctcaccgtatctctacagtggcaactgttttcaagacagtttggctaccattagccgctacctacccataataagactttggcatgggacggaggagttgaacccctttgaaacggtgttggaagccgttgctcatgccttagagtcttaacatcgtcccatactataattcgaagcttaccgtattatctcaacactgtaaagccccttctcagattatttacatgttctggaaaacatgagatacagaccacctccctacaggaagacccgcttaggtcgtctaagtaatctgctaactaattggtcgaggcggcaggactcgaacccgcatactccacttactcggttaacggcggtttagaagaccgctgagatacgccccgtaattatctttaaagactctcttagaaagcccttaaagatgcccaccttattaatcataccgtgggctagtacgccaaattctttgatgagggattggaagacctcactggtgtttagcctatcaagctactgccagaaaaacattgtcgtttgcatttattttaaatttgcaaaatagacgctacgcaacgaaaactattcagaatatgtacaacaaatttccccacattgtgttacgtctaacgctcatgtattggtgtttgaattatacatattctgaagtattttagttactataaagtagtcacatctcaatgtcaacaactttattgaaattggttgtaggtgagggtatcgaaccctcttctaacggttatcagccgtttgcattaccatttatgctaacccacaattggaggttcagatgggaatcgaacccacattcatagggcttatgagacccttgcattaccttatctgcgactgaaccatattggtagaagtggagggattcgaacccatcgcctgtcagattaaaagtctgccgcatcaccattctgctacacttccattaaattatctttgtagataagctacccagacttgcttaaggtctgtagcgatgtgcctttttgggtttaaatctagaatttaccctttcaccctttgtggtcgcatactcacaggtaagcttaataacttatctacaaagataattaccagaccgttgtttatcatcttaagtgctaccattacaccaactcgacacctgccgagtgaaggaatcgaaccttctccttttctttaccgagaaatagattgtttaagttttgctgtaaacggtcttctgtaaatttggaggcgggtgcaggagtcgaacctgccgataccatgctaatgagacatgtgagacgccctttctctatacccgcaattcttaatgaccagaccaaatctcttctttgtccgatttaccttcagatgaataagattaagtttgctgtaattggtcttctgtcaaaactggcgttccagaagggatttgaaccctcaaatatccactttgaaagagtggtgactataccattttgtctactggaacattaatttggtctctgttggaggacttgaacctccggccttaccgccccaaacggaacgctctaccaagctgagctaaacagagataaacttttcaaactctatgtaaccactttaacattattttttagtgattgtcaagaacttttttaaaatatttttcagtatcttagaaaagctctcgtttcgtttctatgtagaacatattaaagggtatcaaacacattgtcaataccctttttaaaactttttaccagatataacggtcaatcattactgctttgagcattacgctgatagggtcaaacttctcaccaccaagcagagcttttaaagtggctggagagaaaccagataccattgctacaccgttatccttaacagatacttcgcaagtaccattacggtttgctaagtaccagaataccagttgtggcatttcgtatccagctttcttgtacttactctggattgcttcaaagtttgtgcgaccgttagctccatcaacctgattgaactccatatctgagaagatgataagcttacttggcatatctttctgagtcaagttatttcttttacctgtctcaagaatacggtcaaaagctgcttgtaagttagttgagccatattcaacgtgccgcatcacctgacgaagacggtttcgtaaatcaccactcagttcgatgaagtgagggtttgttgagtaaaccattaactcatttttaaagcaacctgtattgcgttctgctacatacaatgcaagtgatacaccaatatccagagcagtaatggagccaaaattcacccaagacattgaacatgaaacatcagacatacagagaatgttttcaccctctgccatccagtttggtagtgctttccactgctcattagcaacatctgcattaccatacttaacagacttaatcacatcgtatgggtaaacagcaccagcattaatcttagtctcaccctttgataaggactcgatgtaagctttgtagcgttctccatctttgcggttaaacagtttttggtaacgtgcagcagcaagtgaaggaatcttactgtagtcaatcttaccaaactcattagcagagattttttgctcaactgtatcagagagcgcagacaacagtgtgcgataatctttctcactcaagttggcaaacttacagaaacgttttacaaactgcttatgacgtggtttgactcgtggtaaccacttagctgccaaacctgctgttgcagggtctagtaatgctgcttctaaatgtttgaaggcatctgtctcgaaacgagtacctacgaagattttgaagtcatcaaaacgaccaagttctgcaatcttatccataatgcgaagaacctgtgtaggctctaaaactttatcttcaattgcttgaagcaaaacagttctgaaggctttacgctcacccataccttctcgtacatctcgcatatgcagtaaaatacgaactgcaacatcaacatcgtcacgcaaagctttgtagaacaggtctggtaagatttctacattgctacggctcgaaccagcagctttgtaaaagtctacaagagcagacattgatgaagtatggtttacagcaccattttcagttcgacctgcatgaaggtgcgcatgtttaaataattcgctcatattttactctcttctctcatttgttgtttgatgtgacagactttagagtaactttatagagtctgtcaacatcttttaaaattattttttgagggttgcaacagcagagaacgttggtttgttttctgtctgagactgaatactgttatcaggagtcttcttagtgtctgctgcaatggctttcatctcacctgctgagtgagtcatgatagttttaccgacctcaatcatgctcttgatggttacgtcgtctgtgtttaacccgaactctgcaagcttagcagcgtcccttgtaacaatcgcttcaaacaactttgcagcaaactcagcagaattatcaatggtcagttgagcttttacgagtgagcttttgttacgagagccttttggtcttccagatgggtttccagactggccttttttaaactggcctttgtttgttctgtttttcattggtatgcctcttataagacctcttaaaaggcttttaagataaaagatagatatccagaaagatatctgtttaaatagcctttttagaggaaccttttaagttatcttctaagtatttataagcctataccttgtcaagtactttgtcaacaacttttttaacttgcaatagttcttgacttgttgtatggattactgtaccatcttacttaaagctgtaggtctgccttgttctacaaaggagacttaatgagaaaatcaaataaaccgaagaaaggtaagaataccaatcactgtaaggaatcaaaaagggtagaattaatctactattcatcctctgaaattggtctgtacctgttctttcaaaattacagaagacaagaggattatctatgtgtagttcccaattagaaatcgcagatattatagatttatatcaaactgcaaagagtcatggctatataacctcaattggaaagaatagtcactatgatgctttgactggaatgtatttcagggcaatggctcaatctagtgaacaacacttagtggtttcttccagtgagtttacttcgtttctctattgcagcaaaattataaatcgcaggagaactgaaaaatgttaacagtaagttttaattacaatagtgatggctctgtatcaattaactcaccatatgcaaatgacctacttaaagagctagtcaatcagtgtgagaggggtcttcactatgttcaaaattcttttaaacagaagactattgctaataacttgatgcgtgtaacagtgacggcatcgaatccaaattatgactttgatagtgaaagtccgtactcattagttgcgcttggagagagcagccaattcaaacttgtttgccacgactcagaaacattccttaaggtattttccaaccttatccataataataagtacagctacgttgatggtagtgtaaacttctatccagcaaactatacatgtttgttaattgataatatgagaaaaagtaagcaagagcctacagaaatttcatttgatgtgaactctagtccagacgcagaaacaagtaagaactttgatatgagttacgcattgtcactcagtaagaaatccgagttcattgattatgtcaatggatttggttttaagtttgatgagagtatgaatcttaaaaaacttaagaacctacttaagaccaaagcttaagtgtgaataggggctgatgcccctttaactatttataaggatatttaatgaaagctaagagtgcaaaagacttttattgcttcctacaatcctatatcaattccgtgcaaaatggtgaaaggtacagccttaatgatgttatcccaacacctttgacatggagactcagcaaatggcctgaagaagatattacaccaacaatcgaacagcgtacctacaaacccgaaatcaatattccagactctgagaatctattatatccaatgttccatattgttggtcttggaagattccttatggatatccagtatgtaattggtaaaggttataaggttaaaggtattgttgttggtgacgtatctccgcatcacaaaggttattttagactaaacgcacatttagaggctaaaaagaaatgattaaagcaaagacttactcagacttcaaagagtttgtgaagggcttcattgcaaacgtaaaagctggtaagagatatgattttagaacatatcaagaggctattttaccgcttacctatagttcgtattggcctgaagctgatattgcagaagttgaggagtttgactacaaaccagactacaaagttccatttagtgatgagttgctttacagcatcggtgctcaaatgagaacttctgacttcttcatggacttacaatatgcaattatcaatggtaaagacgttgatacaatttattgtgaatggctggcaagggttaatccgttctcaatgttgaatgctaagttgaaggatgctatcaagccaccagcaatcactcagcagccaaccaatcaaacagtaaatgaaggtgacacacttaccctaagcgttattgcaaccaatgccactggatatcagtggaaaaagggtggtgaggatatcactagtgccacatctgcaacctacacaaaacagtctgtagcaccttctgatgctggctcctatacttgtgttgtatctggagaggctgggacaagtgttacctcagatgcggcaacagttactgtcaacgcactgcctgtgattacacagcaaccttctagccagaccatcaatgagggtggaagcattaacttggaagtgactgcaacaggtgcgacaggttaccagtggaagaaaggggaggaagacatcctcgatgcaactactgcaacttacaccaaagaaggtgcaaccactgctgatgcaggaagctacacctgtgtagttactggtgcaggtggctctgtaacatctaacgcagcaacagttactgttaacccagcaggggaggcataatgcaactctcaagaaaaggtttagaagctattaagttctttgaaggtcttaagctagaggcttacgaagattctgccggaatcccaacaatcgggtatggtacaatccgtattgacggaaaacctgttaagatgggtatgaaaattacggctgaacaagctgaacagtatcttctcgcagatgttgagaagttcgttgcagcggtgaacaaagccatcaaggttccaacttctcagaacgagttcgatgcacttgtaagtgaaacatacaacatcggtatcacagctatgcaggattctacatttatcaagcgccacaacgctggtaataaggtaggttgtgcagaagctatgcagtggtggaacaaggttacagtcaaaggtaagaaggtcacttcaaacggcctgaaaaacagacgtagaatggaagctgacatttatcttgacagtgtatatccaaagtaatatcttcataggctccttcgggagccttttttattttctaaggagaaaactatgaaactttgggctagtgactttggaacttttaaatacactcgtaatggttctcttgtacgcattgtaggaaacaatgttgtttcaagaggcgacaatgtgtatacacggtttactgtagaacttgttgaactgtcacctattgagtctgtgaacaatggcctgttcaagtttgagacttacaatgtcaacgaacatggacaattcaaccctcttggtgaaagtggacttgatattatttcagagcacccattgacaaaagagcaacttgcaggttactataaatctgttctggaaaggcagttagcaacacatgaacaagaagctaactaccatttacagcattgcgaaactttaagagcaaaaatcgaacaagcagagagaggtttttatgaataatatcagtcagattaaagttaaagtcgatgttagccgttacagtggagatgaagaattagacctgcgagatgcgattctctatgagaagaatggtaacctgcatttacattttgaaggtacaaacacatatctacacagatgtcgagatgatgtagatggttgtcctgtttttgcttggtataatttagagttacctctttatgcaatccactacccagatggtggggaagactggactactcaatcaatctttgatgaacttaacggtattccagttgagcaagaagagcaagaacccgttgaacttaccttcacttttatcaaagaagagaaagtaggtgacttgtcagtaaccgaagcaattcaagtctcacaggttattcgttaatgagtaaagtacaggttgttttccctatttgtgacttctcactagagcgtgaacttgacctgtacgaagaaattactgacgaaattatctggtctgttgtagaagaggctatcaagaaactgtatggtggcctcttaaacccatcaagtaaaaagctcaatactaaacaagtagctgatacacacacttcctatgatgcctacaacaaaccttttgagaatacctgctttgaccttatggtaggcaataacaaagtcaactatttcttcgtcagagagtttaacgatgagtaagctccatgtcacagtgtacaaaaacttctcagatattaaagagtctttaacaaataagcttgacttacaacgtaaaaggctctttttaatgtatgacatagacaactacaaccatcctaaagagtttaactacaaagatggtacgaaggtcgttgaatttgaagattctgtgacggtgtatgtcaaatatgacttaccagcaaagtacatagggatgttagagtattacatattcaaacatacaggtatgcgtggtgaagctgtcaagatatcttctatagaagtttttgagaaacctaacacacaacttaaaaaatatttaatgaggaaactgtaatgtccgaagagcaacaggatatcattccacaagtaacacttgtacaacactttggaaatattgaagggtgtgttgcactttttcaaccaagcatcaactctcctgcaaaagtttgcaagctgactatgaatgttaacaacatcagtgtttgccttgttgatgaagttcaatatttcaagttcaatgacagagaggttgatgctgcactattgaagtatcgagcaaacctcgaaaaagatattgaccacaaagaacttgtaacactatttggtgaccttcacaagcttcttgaaaaggttattaagcgtacatactacatgaacaatggttcaattattaccactttgatttcaccatgtatttcagagccaattttaactgatgatggtggctactacgtggtagcatcagcagattctgattggtggatgaagaacacagcacttaaaacagtgattgaggctatccgtgagcatatcccttcatttagcccgtggaaaggtaaaagtgatgatttcattgcactattgagtgaagagagtagcaagcgcagtgcattactgcctaaaaaatactcttgaccaattatacaaaactgattatgatgggagctatcgagaggtagttccctttttagtttctggagagtagatatggctaaagtgaaagaacacgataaaattattttgtatgttaaacagaatccttcaaagagtgttgaggctgttgtaacacatatctcacacaacggtacagtttatttccgaccactgaagaacttagactttgacacaacaccaaaccacacattcagtacttctgcaagactgtgtgcagggactgtatactcaactgctgagattgagtccttatctttcacaggtgcttacaaaaactttatagggattgctctaaaggactctgaagagtcttttaaatttttcatggatgctgctaagggcggtcatacacatattatgccagtctttaagaaagttgatacagaacttaccagtaagtgtgaagagattagtagtgacctgaaggagcgtaaaacagctattcagaatgccatttacatcattgagaggaatcatttagaagttcttttcagagatatgctaaaagcagggtttactccaaacgaaattacaagagaaacacaacgccagttcagaaacgctatggtgaaagaatgaaaaaactaactacagttgaagactactacaaactttccctgttagaacagtatcgcagaagccagaatatcagaaaatgctatggtaagcacgctgaaggtgatttttaccattgctatgatgcagatttaaaaggcgtaacacctagagggaaagttctgcaaagatttgttgaccttgaatggaacaaacgattgagaggggttggaaaatgatttacgaagaaagatacaagatagattttcaggatactcgccatcacacttctttaagagtgacgaaaccaaatggagataccggtatcatagcacattttggtggtgattactggtatggcacaggttgctttgaaggctacactcaagaatacctgaaagctttctacagagactttgcaaatgactacaacagagttgttgacgaaaagaataagtgcattaagcatgaacaccatgccagaggctgcctaagtattgttatgggactggcattcttcttagcaacgttactggcagtatcagtaatcagctacacagctcaagatttgacaattacacagattactacaaagatacacgatatctggtacttgtatgctgttcctttagctggtatcatcatctcactaatgaggttcagagttcataagaaacgacttaaggactctgaggttaaacttgaagaggtaagtaaagaatgcaacctacaattatagctgtatgtgttcgttttgcaatcgctgaaatgattaacaaggcaatcttaaaagatgcctatggagagactaagtaatgattaagacacctgtaccaatttttggatttccttctatagaagagttcaaagtttatcttgacaaaaacttctacaatgagcagcctgttactttgctgaagagtgacttatcagagcttcttgatatggttatcaaggcaactcctgagaaggagcctgaacagaaagctgagaagaagactagtaagaaatccgataagaagactgaaaagtctgagtaataacttaggggttacttgatagcccctttgtagaaacttagaaggtagcgaatatgaaaattaaaaaagtcgttcaaaaagcaatgcttgacaactcaactaaagataaaatgtacaaagagatttgtgataagttgaattgttcaagacatgctgctaaggctcttgtgcattgctttatcttggaatgctcagaagcttatatgaaacatatagcttttgaaagttctaacttactaggtgatgtagaagttggtgagaagctaaaagaacctgagatgaaaacagttcctaaagttggtaatacataccctcttaaagatttcaagactggaaagattgttgcaaaaggtgtagtagaatctgtctatcatgatggtaaatacttacttaaaatatttgagtatgatagccgctatacacacttgtgtggtcttacatttttagtaacagaagaagacctcattaagaacaatgacaacaagtttgcagtaccagattaccaagttttacgataatggtgtgatagctatggaaaaagataacttaaaagaagttgaaggtaactacctagtccttgactggaatgatgttcgagaagcattatccaaagaaagccttgacatactagagcagcttgtcttctcagtacggcatatcagagaagttaagaatggtaaagagccacttgaaggaatctttgtagagaagtcttatccgttctatgaagacactttacagaaagttaaaatgtactttaaacagaagaaccgtaaagtggtcactatggtatctcttggtggacagagtatgtctgtgatggaagatatcaaccctaagagaccaagtaaaggtgtctgtataaaaatcacaggtcatgaagagtatatctcagtggatgattttagtgtgttctgtaatggttctgctgtctttaatgggtttcactatgatatccgagtgtacccaatcaagggagatgatatcatgatgcagatatttgataacaacaatggattcactcatttttatcagacaaccaagtcatcattaaaaacagttctggaaacactgatttaaaatatcttaagagcctccttaattgggggctttttatttttataaaattttatcggttgtcccaacctctgggtcaccatcatatgtgaacaaaatatctatccttcttaacaaccttcttaatcttactctctatatagttatatagtactatatagtatcttagtaactatctagtggtcttaatagccctctgtataacccttctaactagccctctaacaagccttctaaacactcttctaacaagccttcttaacaacctatacaatcaccttaaccacctctctataccctcttagaagctcctatacacctcttaatctctgggttatctatgataccctctataggtgttcactcggtattactaagcttctatatagactgttttaacaaacttaacagggatatctttacagaccttatctcacaaggtctaacacggtactaacaaggtatcttataagcctgtttctacctgtatttttaaaagactgtataggtaattattcagaattttaaaatttttataaaataggactatcaagtcattttttagggtctttgaaggaactgaaaaatatctgattaggatgtatatctgcttggtagcccttaacagccccttaacaccccctttgcagaattttaaaatatccttaacaatctcttaacagttctcacatcttcttaacaactctttaaaggtcttaacagtttcttaacagaactaacaaggctgtaacagttttctaacaagtgctgaataggctttacagatgcttaacagatgactaacaagttaattttaaagagttattttgttaagataattaacaagttcctaacaagtgtttaatctttttaacaagctattaacatgacaactcttctttcttatcgttccctttcctttcttagtgattccttaaacatacctcttaaaagctctctatagctctttataggctcttttaagtctctccctagtatttacccctcaactgtatggatagctctttatagggctttacaggagcttttaaggctatgccaaagactcttacaaggcttttacgtggtcttaacagagatttaacaaggggctaacaagttgctaacaagtgccttaaaagcataactatgtagggtttgttaagaaattgttaagaaaatgttaagggggctagcatttacgtaactttatagctctttttacgtaactttatagctctttttacgtaactttatagctctttttacgtaactttatagctctttttacgtaactttatagctctttttacgtaactttatag

SEQ ID NO: 7 - DNA, 86881 bp, Artificial Sequence
  Bacteriophage San 25
aaagttacgtaaaaagagctataaagttacgtaaaaagagctataaagttacgtaaaaagagctataaagttacgtaaaaagagctataaagttacgtaaatgctagcccccttaacattttcttaacaatttcttaacaaaccctacatagttatgcttttaaggaacttgttagccccttgttaaatctctgttaaaaccacgtaaaagccttgtaagagtctttggcatagccttaaaagctcctgtaaagccctataaagagctatccatacagttgaggggtaaatactagggagagacttaaaagagcctataaagagctatagagagcttttaagaggtatgtttaaggaatcactaagaaaggaaagggaacgataagaaagagagagtgaccatgttaatagcttgttaaaaagattaaacacttgttagaaacttgttaattatcttaacaaaataactctttaaaattaactaattaactcttgttagtcatctgttaagcatctgtaaagcctattcagcacttgttagaaaactgttaagcccttgttagttctgttaagaatctgttaagacctttgaagagttgttaagaagatgtgagaactgttaagagattgttaaggatattttaaaattctgcaaagggggtgttaaggggctgttaagggctaccaagcagatatacatcctaatcagatatttttcagttccttcaaagaccctaaaaaatgacttgatagtcctattttataaaaattttaaaattctgaataattacctatacagtcttttaaaaatacaggtgataacaggcttataagataccttgttagtaccgtgttagaccttgtgagataaggtctgtaaagatatccctgttaagtttgttaaaacagtctatatagaagcttagtaataccgagtgaacacctatagagggtatcatagataacctaatgggttactgttaagtaacacagataacccagagattaagaggtgtataggagcttctaagagggtatagagaggtggttaaggtgattgtataggttgttaagaaggcttgttagaagagtgtttagaaggcttgttagagggctagttagaagggttatacagagggctattaagaccactagatagttactaagatactatatagtactatataactatatagagagtaagattaagaaggttgttaagaaggatagatattttgttcacatatgatggtgacccagaggttgggacaaccgataaaattttataaaaataaaaagcccccaattaaggaggctcttaagatattttaaatcagtgtttccagaactgtttttaatgatgacttggttgtctgataaaaatgagtgaatccattgttgttatcaaatatctgcatcatgatatcatctcccttgattgggtacactcggatatcatagtgaaacccattaaagacagcagaaccattacagaacacactaaaatcatccactgagatatactcttcatgacctgtgatttttatacagacacctttacttggtctcttagggttgatatcttccatcacagacatactctgtccaccaagagataccatagtgaccactttacggttcttctgtttaaagtacattttaactttctgtaaagtgtcttcatagaacggataagacttctctacaaagattccttcaagtggctctttaccattcttaacttctctgatatgccgtactgagaagacaagctgctctagtatgtcaaggctttctttggataatgcttctcgaacatcattccagtcaaggactaggtagttaccttcaacttcttttaagttatctttttccatagctatcacaccattatcgtaaaacttggtaatctggtactgcaaacttgttgtcattgttcttaatgaggtcttcttctgttactaaaaatgtaagaccacacaagtgtgtatagcggctatcatactcaaatattttaagtaagtatttaccatcatgatagacagattctactacaccttttgcaacaatctttccagtcttgaaatctttaagagggtatgtattaccaactttaggaactgttttcatctcaggttcttttagcttctcaccaacttctacatcacctagtaagttagaactttcaaaagctatatgtttcatataagcttctgagcattccaagataaagcaatgcacaagagccttagcagcatgtcttgaacaattcaacttatcacaaatctctttgtacattttatctttagttgagttgtcaagcattgctttttgaacgacttttttaattttcatattcgctaccttctaagtttctacaaaggggctatcaagtaacccctcaagttactactcagacttttcagtcttcttatcggatttcttactagccttcttctcagctttctgctcaggttccttctcaggagttgccttgataaccatatcaagaagctctgataagtcactcttcagcaaagtaacaggctgctcgttgtagaagtttttgtcaagatagactttaaactcttctatagaagggaatccaaaaattggtacaggtgtcttaatcattacttagtctctccataggcatcttttaagattgccttgttaatcatttcagctattgcaaaacgaacacatacagctataattgtaggttgcattctttacttacctcttcaagtttaacctcagagtccttaagtcgtttcttatgaactctgaacctcattagtgagatgatgataccagctaaaggaacagcatacaagtaccaaatatcttgtacctttgcggtaatctgtgtaattgtcaaatcttgagctgtgtagctgattactgatactgccagtaacgttgctaagaagaatgccagtcccataacaatacttaggcagcctctggcatggtgttcatgcttaatgcacttattcttttcgtcaacaactctgttgtagtcatttgcaaagtctctgtagaaagctttcaggtattcttgagtgtagccttcaaagcaacctgtgccataccagtaatcaccaccaaaatgtgctatgataccggtatctccatttggtttcgtcactcttaaagaagtgtgatggcgagtatcctgaaaatctatcttgtatctttcttcgtaaatcattttccaacccctctcaatcgtttgttccattcaaggtcaacaaatctttgcagaactttccctctaggtgttacgccttttaaatctgcatcatagcaatggtaaaaatcaccttcagcgtgcttaccatagcattttctgatattctggcttctgcgatactgttctaacagggaaagtttgtagtagtcttcaactgtagttagttttttcattctttcaccatagcgtttctgaactggcgttgtgtttctcttgtaatttcgtttggagtaaaccctgcttttagcatatctctgaaaagaacttctaaatgattcctctcaatgatgtaaatggcattctgaatagctgttttacgctccttcaggtcactactaatctcttcacacttactggtaagttctgtatcaactttcttaaagactggcataatatgtgtatgaccgcccttagcagcatccatgaaaaatttaaaagactcttcagagtcctttagagcaatccctataaagtttttgtaagcacctgtgaaagataaggactcaatctcagcagttgagtatacagtccctgcacacagtcttgcagaagtactgaatgtgtggtttggtgttgtgtcaaagtctaagttcttcagtggtcggaaataaactgtaccgttgtgtgagatatgtgttacaacagcctcaacactctttgaaggattctgtttaacatacaaaataattttatcgtgttctttcactttagccatatctactctccagaaactaaaaagggaactacctctcgatagctcccatcataatcagttttgtataattggtcaagagtattttttaggcagtaatgcactgcgcttgttactctcttcactcaatagtgcaatgaaatcatcacttttacctttccacgggctaaatgaagggatatgctcacggatagcctcaatcactgttttaagtgctgtgttcttcatccaccaatcagaatctgctgatgctaccacgtagtagccaccatcatcagttaaaattggctctgaaatacatggtgaaatcaaagtggtaataattgaaccattgttcatgtagtatgtacgcttaataaccttttcaagaagcttgtgaaggtcaccaaatagtgttacaagttctttgtggtcaatatctttttcgaggtttgctcgatacttcaatagtgcagcatcaacctctctgtcattgaacttgaaatattgaacttcatcaacaaggcaaacactgatgttgttaacattcatagtcagcttgcaaacttttgcaggagagttgatgcttggttgaaaaagtgcaacacacccttcaatattcccaaagtgttgtacaagtgttacttgtggaatgatatcctgttgctcttcggacattacagtttcctcattaaatactttttaagttgtgtgttaggtttctcaaaaacttctatagaagatatcttgacagattcaccacgcataccagtatgtttgaatatgtaatactctaacatccctatgtactttgctggtaagtcatatttgacatacaccgtcacagaatcttcaaattcaacgacctttgtaccatctttgtagttaaactctttaggatggttgtagttgtctatgtcgtacattaaaaagagccttttacgttgtaagtcaagcttatttgttaaagactctttgatatctgcgaagtttttgtaaactgtgacatggagcttactcatcgttaaactctctgacgaagaaatagttgactttgttattgcctaccataaggtcaaagcaggtattctcaaaaggtttgttgtaggcatcataggaagtgtgtgtatcagctacttgtttagtattgagctttttacttgatgggtttaagaggccaccatacagtttcttgatagcctcttctacaacagaccagataatttcgtcagtaatttcttcgtacaggtcaagttcacgctctagtgagaagtcacaaatagggaaaacaacctgtactttactcattaacgaataacctgtgagacttgaattgcttcggttactgacaagtcacctactttctcttctttgataaaagtgaaggtaagttcaacgggttcttgctcttcttgctcaactggaataccgttaagttcatcaaagattgattgagtagtccagtcttccccaccatctgggtagtggattgcataaagaggtaactctaaattataccaagcaaaaacaggacaaccatctacatcatctcgacatctgtgtagatatgtgtttgtaccttcaaaatgtaaatgcaggttaccattcttctcatagagaatcgcatctcgcaggtctaattcttcatctccactgtaacggctaacatcgactttaactttaatctgactgatattattcataaaaacctctctctgcttgttcgatttttgctcttaaagtttcgcaatgctgtaaatggtagttagcttcttgttcatgtgttgctaactgcctttccagaacagatttatagtaacctgcaagttgctcttttgtcaatgggtgctctgaaataatatcaagtccactttcaccaagagggttgaattgtccatgttcgttgacattgtaagtctcaaacttgaacaggccattgttcacagactcaataggtgacagttcaacaagttctacagtaaaccgtgtatacacattgtcgcctcttgaaacaacattgtttcctacaatgcgtacaagagaaccattacgagtgtatttaaaagttccaaagtcactagcccaaagtttcatagttttctccttagaaaataaaaaaggctcccgaaggagcctatgaagatattactttggatatacactgtcaagataaatgtcagcttccattctacgtctgtttttcaggccgtttgaagtgactttcttacctttgactgtaaccttgttccaccactgcatagcttctgcacaacctaccttattaccagcgttgtggcgcttgataaatgtagagtcctgcatagctgtgatgccaatgttgtatgtttcacttacaagtgcgtcaaactcattctgggaagttggaaccttgatggatttgttcactgctgcaacgaacttttcaacatctgcgagaagatactgttcagcttgttcagccgtaattttcatacccatcttaacaggttttccgtcaatacggattgtaccatacccgattgttgggattccggcagaatcttcgtaagcctctagcttaagaccttcaaagaacttaatagcttctaaaccttttcttgagagttgcattatgcctcccctgctgggttaacagtaactgttgccacattagatgttacagagccacctgcgccagtaactacacaggtgtagcttcctgaatcagcagcggttgcaccttctttggtgtaagttgcagtagttgcatcgaggatatcttcctcacctttcttccactggtaacctgttgcacctgttgcagtcacttccaagttgatgtttccaccctcattgacggtctgaccagaaggttgctgtgtaatcacaggcagtgcattaacagtaactgttgccgcatctgaggtaacacttgttccagcctctccagatacaacacaagtgtatgaacctgcatcagaaggtaatacagactgttttgtgtaggttgcagaggtggcactagtgatatcctcaccatcctttttccattgatatccagtggcattcgttgcaacaacacttagggtaagcgtaccaccttcatttactgtttgattggttggctgctgagtgattgctggtggcttgatagcatccttcaacttagcattcaacattgagaacggcttaaccattgccagccattcacaataaattgtatcaacgtctttaccattgataattgcatattgtaagtccatgaagaagtcagaagttctcatttgagcaccgatgctgtaaagcaactcatcactaaatgggactttgtagtctggtttgtagtcaaactcctcaacttctgcaatatcagcttcaggccaatacgaactataggtaagcggtaaaatagcctcttgatatgttctaaaatcatatctcttaccagcttttacgtttgcaatgaagaccttcacaaactctttgaagtctgggtaagtctttgctttaatcatttctttttagcctctaaatgtgcgtttagtctaaaataacctttgtgatgcggagatacatcaccaacaacaatacctttaaccttatagcctttaccaattacatactggatatccataaggaatcttccaagaccaacaatatggaacattggatataatagattctcagaatctggaatattgatttcaggtttgtaggtgcgttgttcgcttgtcggtgtaatatcttcttcaggccatttactgagtctccatgtcaaaggtgttgggataacatcattaaggttgtacctttcaccattttgcacggaattgatataggattgtaggaagcaataaaagtcttttgcactcttagctttcattaaatatccttataaatagttaaaggggcatcagcccctattcacacttaagctttggtcttaagtaggttcttaagttttttaagattcatgctctcatcaaacttaaaaccaaatccattgacataatcaatgaactcggatttcttactgagtgacaatgcgtaactcatatcaaagttcttacttgtttctgcgtctggactagagttcacatcaaatgaaatttctgtaggctcttgcttactttttctcatattatcaattaacaaacatgtatagtttgctggatagaagtttacactaccatcaacgtagctgtacttattattatggataaggttggaaaataccttaaggaatgtttctgagtcgtggcaaacaagtttgaattggctgctctctccaagcgcaactaatgagtacggactttcactatcaaagtcataatttggattcgatgccgtcactgttacacgcatcaagttattagcaatagtcttctgtttaaaagaattttgaacatagtgaagacccctctcacactgattgactagctctttaagtaggtcatttgcatatggtgagttaattgatacagagccatcactattgtaattaaaacttactgttaacatttttcagttctcctgcgatttataattttgctgcaatagagaaacgaagtaaactcactggaagaaaccactaagtgttgttcactagattgagccattgccctgaaatacattccagtcaaagcatcatagtgactattctttccaattgaggttatatagccatgactctttgcagtttgatataaatctataatatctgcgatttctaattgggaactacacatagataatcctcttgtcttctgtaattttgaaagaacaggtacagaccaatttcagaggatgaatagtagattaattctaccctttttgattccttacagtgattggtattcttacctttcttcggtttatttgattttctcattaagtctcctttgtagaacaaggcagacctacagctttaagtaagatggtacagtaatccatacaacaagtcaagaactattgcaagttaaaaaagttgttgacaaagtacttgacaaggtataggcttataaatacttagaagataacttaaaaggttcctctaaaaaggctatttaaacagatatctttctggatatctatcttttatcttaaaagccttttaagaggtcttataagaggcataccaatgaaaaacagaacaaacaaaggccagtttaaaaaaggccagtctggaaacccatctggaagaccaaaaggctctcgtaacaaaagctcactcgtaaaagctcaactgaccattgataattctgctgagtttgctgcaaagttgtttgaagcgattgttacaagggacgctgctaagcttgcagagttcgggttaaacacagacgacgtaaccatcaagagcatgattgaggtcggtaaaactatcatgactcactcagcaggtgagatgaaagccattgcagcagacactaagaagactcctgataacagtattcagtctcagacagaaaacaaaccaacgttctctgctgttgcaaccctcaaaaaataattttaaaagatgttgacagactctataaagttactctaaagtctgtcacatcaaacaacaaatgagagaagagagtaaaatatgagcgaattatttaaacatgcgcaccttcatgcaggtcgaactgaaaatggtgctgtaaaccatacttcatcaatgtctgctcttgtagacttttacaaagctgctggttcgagccgtagcaatgtagaaatcttaccagacctgttctacaaagctttgcgtgacgatgttgatgttgcagttcgtattttactgcatatgcgagatgtacgagaaggtatgggtgagcgtaaagccttcagaactgttttgcttcaagcaattgaagataaagttttagagcctacacaggttcttcgcattatggataagattgcagaacttggtcgttttgatgacttcaaaatcttcgtaggtactcgtttcgagacagatgccttcaaacatttagaagcagcattactagaccctgcaacagcaggtttggcagctaagtggttaccacgagtcaaaccacgtcataagcagtttgtaaaacgtttctgtaagtttgccaacttgagtgagaaagattatcgcacactgttgtctgcgctctctgatacagttgagcaaaaaatctctgctaatgagtttggtaagattgactacagtaagattccttcacttgctgctgcacgttaccaaaaactgtttaaccgcaaagatggagaacgctacaaagcttacatcgagtccttatcaaagggtgagactaagattaatgctggtgctgtttacccatacgatgtgattaagtctgttaagtatggtaatgcagatgttgctaatgagtagtggaaagcactaccaaactggatggcagagggtgaaaacattctctgtatgtctgatgtttcatgttcaatgtcttgggtgaattttggctccattactgctctggatattggtgtatcacttgcattgtatgtagcagaacgcaatacaggttgctttaaaaatgagttaatggtttactcaacaaaccctcacttcatcgaactgagtggtgatttacgaaaccgtcttcgtcaggtgatgcggcacgttgaatatggctcaactaacttacaagcagcttttgaccgtattcttgagacaggtaaaagaaataacttgactcagaaagatatgccaagtaagcttatcatcttctcagatatggagttcaatcaggttgatggagctaacggtcgcacaaactttgaagcaatccagagtaagtacaagaaagctggatacgaaatgccacaactggtattctggtacttagcaaaccgtaatggtacttgcgaagtatctgttaaggataacggtgtagcaatggtatctggtttctctccagccactttaaaagctctgcttggtggtgagaagtttgaccctatcagcgtaatgctcaaagcagtaatgattgaccgttatatctggtaaaaagttttaaaaagggtattgacaatgtgtttgataccctttaatatgttctacatagaaacgaaacgagagcttttctaagatactgaaaaatattttaaaaaagttcttgacaatcactaaaaaataatgttaaagtggttacatagagtttgaaaagtttatctctgtttagctcagcttggtagagcgttccgtttggggcggtaaggccggaggttcaagtcctccaacagagaccaaattaatgttccagtagacaaaatggtatagtcaccactctttcaaagtggatatttgagggttcaaatcccttctggaacgccagttttgacagaagaccaattacagcaaacttaatcttattcatctgaaggtaaatcggacaaagaagagatttggtctggtcattaagaattgcgggtatagagaaagggcgtctcacatgtctcattagcatggtatcggcaggttcgactcctgcacccgcctccaaatttacagaagaccgtttacagcaaaacttaaacaatctatttctcggtaaagaaaaggagaaggttcgattccttcactcggcaggtgtcgagttggtgtaatggtagcacttaagatgataaacaacggtctggtaattatctttgtagataagttattaagcttacctgtgagtatgcgaccacaaagggtgaaagggtaaattctagatttaaacccaaaaaggcacatcgctacagaccttaagcaagtctgggtagcttatctacaaagataatttaatggaagtgtagcagaatggtgatgcggcagacttttaatctgacaggcgatgggttcgaatccctccacttctaccaatatggttcagtcgcagataaggtaatgcaagggtctcataagccctatgaatgtgggttcgattcccatctgaacctccaattgtgggttagcataaatggtaatgcaaacggctgataaccgttagaagagggttcgataccctcacctacaaccaatttcaataaagttgttgacattgagatgtgactactttatagtaactaaaatacttcagaatatgtataattcaaacaccaatacatgagcgttagacgtaacacaatgtggggaaatttgttgtacatattctgaatagttttcgttgcgtagcgtctattttgcaaatttaaaataaatgcaaacgacaatgtttttctggcagtagcttgataggctaaacaccagtgaggtcttccaatccctcatcaaagaatttggcgtactagcccacggtatgattaataaggtgggcatctttaagggctttctaagagagtctttaaagataattacggggcgtatctcagcggtcttctaaaccgccgttaaccgagtaagtggagtatgcgggttcgagtcctgccgcctcgaccaattagttagcagattacttagacgacctaagcgggtcttcctgtagggaggtggtctgtatctcatgttttccagaacatgtaaataatctgagaaggggctttacagtgttgagataatacggtaagcttcgaattatagtatgggacgatgttaagactctaaggcatgagcaacggcttccaacaccgtttcaaaggggttcaactcctccgtcccatgccaaagtcttattaggggtaggtagcggctaatggtagccaaactgtcttgaaaacagttgccactgtagagatacggtgagggttcgactcctttacttaccgcctaataagatttaaagccaagcttcattcggatgttgctttggtatccctcgtgtattgtcgtacatactgataaaacacctagtaggtgtcacggagaagagataatatcaagctctccaaaggttctagtcaccggattaaacaagactatgcaaagacctttttaggtctttttagagggcttctaaggttattacagcttgttgtggaaccttgttgcttaggttcttagaagttctctaaaaagatttaatgggagattgacggtaattggtaaacctacctcgcttagaacgaggtgtttgagggttcgaatcccttgtctcctaccaaattaatgcaggtgtagcaaaatggttatgcggctgactcttaatcagtaagacgatgggttcaattccctccacctgtaccaaacattggggatgtagtttacatggttaaaacataagttttgcaaacttaagtacagggttcaattccctgcttctccaccaattagtgcatccatagtttaaacgggaaaattacagtcttccaaactgaggttgagggttcgattccctctggatgctccaaataatgctgctttcgtataattggctattacacatcccttgtaaggatggaaatgcaggttcgagtcctgtgagcagcaccaattcagaggtcaagtgaaagaccgctggtgtcaactgaagaccgtaacaaattccacggagttgagttagcggcacaacttcagacctctttcacactcgcttagtttatatggtaaaacatcacccttacaagatgaagaaaaaggttcaagtcctttagtgagtaccatgttccagtatcccaattggcagaggatgcaagctcaaaccttgtattagtgacggttcgaatccgtcttggaacaccaatttaaagaggctatttaatgagatatttgaagtatgcttcatggattttcttagctttactagacccaattgcagcaaccctagcagtcatcttagcacctttcgtagttccattctacagtgagaagaaaggacatctaccttttggattcagatggatggagacctatgacaacccaattgatggtgatgaaggtcacgttaaaagatgggctaagattagaaagattggtaagctgggtgtctacatgcagagagtcggatggctctggagaaacaaagcttataacttctcttaccatgtattaggaagagatgtaaaagatgttactaagtggaaaggtaatatcaacgtaagttctgaccctgaagataatcagactggttatctcctaatgtggaacaacaatgcttggggattattcgcttttattccgtcaattaaagtctttggtaaacagttttactggagaatttatgttggatggaaactaaaaagtgttgtcccagaagaaagagcattctcaagggaaagagttatgttggcattctttattcatccactgagaaagtaaagatttaaaggggattagtttacaaggttaaaacctcggtctttgaaatcgaagaagttggttcaattccaacatcccccgccaatgctccattactccaattggcagagaggccagacttaaaatctgtgttatgtatcggttcgaatccgatatggagtaccaattttagcggtatagcataactggcaatgcagcagtctctgaagctgtcctattaaggttcaaatccttatgccgctgccacttctaagggttcttacgagagtccttaaatgtggccttatcataaacggtaatgacccatgctgtgaacatggtctatacgggttcaaatcccgtaggtcaccccaatttatagtccaagtagcttatatggttaaagcgcgtgtctgaaaaacatgagaagagggttcaaatcccactggactaccaatttcaaaggtgcttaatgaaagagatgacaggacaaggtaaggagatttttaatctcttaaaaaccggtaaagggttttctaacccacttattactggtgcagcagttctcggtggaaccgtagctgcctctacatcacttgtaagctctattagctctgtaacagacccgacaatgaatgagaaacttgttgctgctggacttacaacagcccttctaaacagctttacaacaagcctgacaagcactacagcaactactaagaccctaacagactatggtcaaaaatctattgatgagttttcatcacgtatgcaggtagcaaaggggtattccaatgttatgggtgcagcaggagaacaagttggttgtacaccatttagtggtattatgggtgttgctacagagtatggtcagcaagctattgacacgattaacagcacactagacagtgttaacggtgtgttaagtgacttacaagacgctattgataagggtcttgatactgtttctgatttagctaaccaagctgttagcaagattaatgaaggtatctcaaagattacagcttatgcagatgaagttgtgcagatgattgaagaagaagctgcccttattgcagagtaccttaaaacgaatatcaatgggttcttagcaggtatcttaccagactggtttgatgatgctcgcaaaactggtgtaatcgacactattgcaacaccagaaatgaagaacgcattacagaaataatggaagattaaccctaaaaggtaagggagcagtttgctaaactgccagtagctgagaaatcggtgtaccagttcaagtctggtatcttcctccaatctgaatccgtgacagaaatggatatgtgcctgtctgcaaaacaggtttataagggttcaagtcccttcggattctccaagttattttactctctctcaattaaaataataataatgccctgctataagtattcttcctttcgctaccgaagagtatttttagacagggcttttttacagagttatactttataggaagacttatacagtatgtctctgacgtacattgtggtttctccttgacggtctctgtgccgtcttttttaaggggaaacaagatttattatttggagaaaacataatgagcgagaacgtttataaagaactttatgaagctaacaagaagttagagtttatgcagaatactatcatggcaattgcagacagattatctgtagcaacaggcattgatattaaagaagcatctatggatgcacttcttgatgctgttgatgcaaagttcgaagttaagaaagaagagactgcgacagactctgaataattctatttgcggaggcgcttaatggacttaaatgctgttaagcagaagcgagtggaagatgttaggaaagtcctagctggagagttggggctttctgatgaagtaaaagaaattatcaaatcattcggtaaagacccctctaaattccttccaactcaaattctgactttattaagatacacaccagaccaagttcgccttatctttaaattgatgactgataagaattatgtggcccctcaaccgggttctcaagaggtctttttaaacactaatgctgacttggttctttatggtggtgctgctggtgctggtaagactgctgcattgttaatggactctttaagatttattgaagaccctaactataatgctgtgtatttccgtcgaaacacaacacagttacaaggtggtttatggcctgctgcaaagaaactatttggtaagtttggtgggattcctcacgagcagaaaatgactatcacattcccttctggggcgactatcaagtttacctatctagaacttgaaaagcacgctgaaggtcatcagggtattgaatactcagctatttactttgacgaaggtacacacttctctgcttcacagatttcatacctacaaacccgtctacgttctggtgctgaaggtgattcatacatgaagatttccatgaacccagacagagaccactttatttatgattgggtagagccattcttagatgaaggaggttatccagaccctgaaaagtgtggtcgtattcgttggtatgtaatgaatgatggtgtgatggtttctgattgggagagagacaagattcttgaaatgttccctcttgagattcctcaaacatacacctttatctctggtacgattgatgataacccaatccttgacttcttagaaccaaagtatcgcggtaagcttgaaaacaacactcctgtgaacgttgcaagacttcgtttcggtaactggaaggctcgtgcagaaggttcaaactattggcaaagacaatggtgtgaaattgttgattcactcccagaagatgtatttgatgttagagcatgggacttagcagcaactttaccatctgagattaaccctaatccagactggacagcaggtgttaagatgggtaaatctaaaaaagacggttgctattatatcattgatgtagtaagatttagagatagaccctctggagtcgaaacacaaattaatttgactgctgaaagtgacggtaagcgaactggtatttttatccctcaagacccaggcgctgctggtaaatcctacgcgacatccctcatcaggaaacttgccgagaaaggttatcgagcaagagctaaaccaacaaataaagataaagttacccgctttgcggggttttcttctgcttctgaagctggacttgtaaaagttttgagaggtagttggaacgaagcttatttccaagagcttgaaggcttttgtggtgatggcaaaactaaagatgaccaagtggatgctaccagtgatgctttcaacagtcttaacgaagttaaattattcaagccaccatcaatgggtgctcacacagacttagtgagaggaaatccatatgaggggcttagacgttgatagctaggtgagaagaatggcagatattacagaaacacaagaaagcttaccaccatttagaatgggtgaagtaggttctttgggtctgaaggttaagaatggaagaatctatgaagaacctcgtcaggcactaaggttccctgaaagtattaaaactttccaattaatgatgcgtgaccctgctgtagcagcatctgtaaatattattaagatgtttgtcagaaaagtcaactggagatttgtacctccaaagggaaaagagcaagaccctaaaatgcttgaaagagcagacttctttaattctttaatggatgacatggagcatgattgggcagattttattaactctgtaatgtcattctgcacttatgggttctgtgttaacgagaaagtttataagaagcgtcagggtaagaaaggaaagtaccagtcaaaatttgatgatggtctaattggatgggctaaattaccaatcagaaaccagtcaacacttgataagtggtattttgacgaagactttagaaaagttactggtgttaggcagaatctgagaaatgtttcacatattgctggagcaattaatctcggagaaaggccactaacaagaaaactcccacgagctaaattcatgctgtttaagtatgatgatgaatatggaaacccagaaggtcgttcaccattacttaatgcctatgtaccgtggaagtataaagttcagattgaagagtacgaagccgttggtgtttcaagagacttggtaggtatgccaaagattggtttaccaccagattatctggatgaaaatgcagaacctgaaaagaaagctttcgtacaatactgcaaaactgttgttaacgatatgattgctaatgatagagcaggtttaatctggcctagatatatcgacccagatactaaagaggatatttttgagttctcattagtttctagacagggtgctaaagcatacgatacaggttctattatcgacagatattccaagcagattatgatggcatttatgtcagatgttcttgctatgggtcagtcaaaatacggttcattctctcttgcagattctaagacaagcttattagcgatgtcagtagatatcctgctgaagcaaattaagaacgtaattaaccgtgatttagttgcacagacttacgctcttaatatgtgggatgatgaagaacatgtgcaaatcacatatgatgatatcgaaactccagaccttgaagcaattggttcttatattcagaagactgttgcagtaggtgctttggaagttgacaaagagctatctaacaagcttagagagcatattggtcttcctcctgctgatgagtctcaaccagtatctgaaaagctttctccaaatagccaaagccgttcaggagatggctataagactgctggagaaggtactgcaaagacaccttcagcaaaagacccaagcacagcaaataaggcaaataaataatggctgaagttatctctatttcaaatgctacacgagtgcattcgtatagaggtgttcttattatcactgacaaattatctgtagaggctggctcaagggtcagcctttcaggttacgtaagtgacggtggaacctctgacgttttcactatttgtaggttacttgatgctccaatgagcggaaaaccgtttatttcaggaaattgtagtgaaattgttaaaattccatttgacagttcatgccttttgggtgtaaagttatataactgcgagaataaacgtatcaatgttaatagcattgaagccgctttcattaccctcgacactgcatttcaatctccaatgacagttaataaagaaacaaacagacttgaatacattttttcacaaaatgattacaaagtacttgtcaaaggcaaagtatatgatatgattgtaaatgtggtagatgaatctggtaaccattcaacagtccttaaacaaaaagtaaggtttaattaatgggaacattaactattgatggtaagaataaaatcctcgccacgctaaccccaacgactattattttacacaatgtagacccaacggcagaccctacagcaaataaggttactcagccagtggctatttatttttctgaaccggataatggcttaattgcctcagaagacacagttaacattactgttccagcttctgcaacggtctcacactatagcttgtgggatgctaacgataaatgcgtggcaactggtgctcttagcaaacctcaattctttgctgaagaaggtatctatgttatctcttcagtctctgtagatttaaacaaatagggtgagtaaaaatgagttcgaatatcttcagacttgctgatagattattcaaccaacctttactagccactgaatcattagctcactcagcagcaacttatgtgaataacagattgctgggtgatgtccaagcagcagtaaactttgataaacccaaaggtgaagcaagaagtcttttaaaagtaaaagatgacattgctattatccctattatgggtggtttaacccatcgtatgacattcattgatgcaatgtgtacaggtggattaagctcttatgagggtttacgtagaggctttgacgaagctttagcagatgagtcaattaagactattgttctgcacattgattctggtggtggtgaagcttcaggttgctttgaattagcacgtcacatcatggcttcaagaggccaaaagaaaattattgcttatgtagatgagttcgcttgttctgctgcatatgctcttgcatcttctgctgaagaaattattgcatcaccagatgcagatgttggttctattggtgtaatcatggttcatcaggaattaactaaggcatttgaaaagaatggcgtaacaattaacgtcatcaaagctggtgagtttaaaggtatgggttcaccattccaagcactctcagaagaaagcaaagaaagacttcaaaagagaattaatgatacctacgcaacctttacaggttttgtagctgaatctcgtaatctctctgaagaagctgtaaagaatactgaggcgaatgtttattctgctcaggaagctcttgaacttggtttaattaactcaatcatgtctcaagatgatttcttaaattacttacaaggttctgaagaggctcctgtaagtttaaacgttaacaattcaggtgaagaaatgactgaacaagaaaagcaagaactagaagctttgcgtcttcaggttgctcaaatgaaagctaaagaacaggaagctgctttgtcagatttgactaataagatttctgcttctgctgaagcttttggatttgatgcaaaagaagctgcaacgactattttaggtgctggtcttgataaccctctgagtgttctgtttatgaatgctatggaaggtgctaaccagaaacttaatgaaactatcgcgtcccatgcttctgcaatggaagaaaaagaatcagaaattaccaagctgaaagaaactgctggtgctgttcttgaacattccaatgctatggaagaagtgggtaatgacggcgaagctgatttggttgaagaagaaaaagaaccagctaagaatgcttccgaagacaccgctgaacaacgcaaactggctctccagaatgctctaaaatctcttatcaaataaggaacacaataatggcatatcaaggttttactaagttaggtaacagagaacctctgaatgatatcattctttgggaacaggttaccccaacaggtcactctcgcaaagagtacactccggttgcttcaacagaataccgtgtaggtgaagttctgaaagcagatggtactaaggttacagcagggcaagaagctcaggctgattcagtatgtatcgttaacttttatgcagacctgcaactgtcttatcatggtcagttgaaagttgttggtatccaccgtgatgcagaactgaaagacatgctgactcttgaagcaagcgttgacgctgccgcagtcaagaaagctctggctgccaaaggtattgatttcgtaccaactggcctgtaataacaataataagacattctggagaattttacaatgttgactaattctgaaaaaagcagatttttccttgctgacctgactggtgaagtccagtctatcccaaatacttatgggtatatttccaacttaggtctgttccgttcagcaccaatcacccaaactactttcctgatggacttgactgattgggatgttagcttgcttgatgcggtagaccgtgatagccgtaaagcagagactagcgcacctgagcgtgttcgtcaaatcagcttcccaatgatgtacttcaaagaagttgaaagcattactcctgatgagattcagggtgtacgtcagccaggcactgcaaatgaactgactactgaagctgtagtacgtgctaagaagctgatgaagattcgtaccaagttcgatattactcgtgagttcctgtttatgcaagctctgaagggtaaagttgttgatgctcgtggtactctgtatgctgacctgtacaagcagttcgacgttgagaagaagactatttacttcgaccttgacaaccctaatgctgacatcgacgcttctatcgaagaactgcgtatgcacatggaagacgaagctaagactggcactgtaatcaacggtgaagaaattcacgtagttgttgaccgtgtattcttcagcaaactggttaagcatcctaagattcgtgacgcttatcttgcacagcagactccactggcttggcaacagattactggttctctgagaactggtggtactgacggcgttcaggctcatatgaacaccttctactacggtggtgttaagtttgtccagtacaacggtaagttcaaagacaagcgtggtaaggttcacactctggtgagcattgatagtgtagcagcaactgttggtgttggtcatgccttccctaacgtatctatgctgggtgaagctaacaacatcttcgaagtggcatatggcccatgtcctaagatgggttacgcaaatacacttggtcaggaactgtacgtattcgaatacgaaaaagaccgtgacgaaggtattgacttcgaagctcactcttacatgctgccatactgcactcgtcctcagttgctggtagatgttcgcgctgacgctaaaggtagctaataaacttaggagggttatgaatgtgttatacaggcgacccagccaataaccctcttgatagagtaagaatcctctgcacagacactaataatgatgaaattcttattgagcagtctgtgctagagtggttctatctagaatctggaaaggatgaaaagaaagcagccatcaaagctcttaaatatttactctttcaagtagccaagatgggagatgagaaggttggtggtgtttatttacgtaactcttccagattcaaatctctgaaagctgtttatgatgaccttgttaaaagctctgtttcaggactaccctatgcaggtggtattaatcagtgtgatattgacatgcgtcgtcagaatccttgctctgtcaagaaatacacagaatatggtgatgctgccagatacgaaggcagagattactgcaaccgtgttaatggcgtatttattatcgagcgagatgaataatggttaaaagggttattcaccccgctagagcaaaattagtcggggctatgaagaacttgcaaacggctaatgctcaagttgggtattttcaagaacaaggtcaacatagctctggtttttcttatcctgctttaatgtatttgcaagaagttattggggttccttcagcttctggtaaagtgtatcgtaggttgtttgaaatcactatgatgctaaacaaacagaccttgttagagcagactaagaagaatctatataagcaacttagcagtctcaacacagacccttcaaataccttagaagcatttgcaaagaatgctcaaaaggcaattaaaagaggttttggtaactctgctatactccctcctaacgcaccttccacagtcaagaaaaaaggctttaacgcacctcttgttgagacaggtgacttaagagataaccttgcttataaaatttctactaagaagggtattaagaaatgagactcttaaacagacacagctttgtagtaaagcgtaaagtctctgaagacggttattataatgatgatggtgattgggtagcttcacaagatattgtagaggttaactgtaaaggtaatatccagccatatatcaaaggttctgtaaagaatggtacacagattgctttaccggaaggtatcagacttaccgatacaagaatcctgtatactacatataaacttagaacttcagatgatgtagagtggaatgagtctgatattgttatgattgatggtcatgagtatgaagtatttatgactatggattggtcacagcaattagcccatacgtcccattatgaatatatcattattagaagggataaaatgaatgcagttagaaacagcagaacttgaaaaaggtctagttagaaccttagtggatgttattggtcacagattagctcgtgataaaaataataggccaaacgtaattagagcttacccttctgataactcaaatgacaaaggtttaaaacctgaccagccatttatcactgtatattgtcaagatgctgcaacaccttatggttgggttcttgataagtttgttgaggatgatgtagtttgctacagaattgcttttcagattccagtattaattacggtgaatggtaaaggtgctcacagtattatgcttgagcttaaacaacgattagagatgagttcagtcagagatttaatccttgaagagacaggagctacagtactagacactggagctatcccgaatgactatacttatctcaatacagatttcgaaaattctgcgcctcttgttgtaactcttgtaaaaaactcagtcctgaaggatgaacgtggaagtattattgagcgtgtcattgttgatggtgagttggtttatgaagaaggacaagagccaccagaatatactatccatctagatgtagactccaaaggggtaaaataaatgtggaatccaattgttaatgtagatattacattgaacaccgcaggaactacaagagaaggttttggtttgccactattcttagcttcaacagataactttgaagaaagagtgcgtggttacacttccttaactgaagttgctgaagatttcgatgaaaatactgctgcatataaagctgctaaacaactttggagtcagactcctaaagtaactcagctttatatcggtagacgcgctatgcagtacactgtatcaattcctgatgccgttaccgaaagtacagactactcaattactgtagctgctggcggtggaatttctcaaccataccagtacacagcacaaagttcagacactgctgaggtagtgttacaacagtttaaaacacagattgaagctgacccaacaatcaaagataaggtttctgtgaatgtaactggtagcaatggctctgccacaatgattattaccaaagctggtgataatgactttgtgaaagtaacaaccacagcacagactgtatatattgcaagtacaactgccgatacagcagcaactgctctggcagccattgaagcttattctactgactggtatttcattgcagcagaagacagaactcaacagtttgtcttagcaatggcttctgagattcaggctcgcaagaaaatcttctttacagctaactccgatgtaacagccctgcaaggtacagaattagccagtgcaaatgatgttccagcacagcttgctaagaatatgtacactcgtacagtttgcttgtggcatcacgcagcagcagaagattacccagagatggcatacattgcttatggtgctccatatgatgcaggttcaattgcttggggtaatgctcagctaactggtgtagcagcttctctacaaccatctaatcagagacctctgacaagtattcagaagtctgctttagatgtacgtcactgtaactttattgaccttgatggtggtgttccagtggttcgtagagggattacttctggtggggaatggattgatatcgtccgtggtgttgactggttagaatcagacctgaaaacttctctgagagacttgctaattaaccagaagggtggtaagattacttatgatgatactggtattacccgtattcgtcaagtcattgaaacctctctgcaaagagcagtcaacagaaacttcctgtcatcttacacagttaatgttcctaaagcctctcaagttgctttagcagacaagaaagctcgtatcctgaaagatgttaccttcgcaggtatcttagcaggggctatcttggatgttgacttgaaaggtacagtggcttacgaataatagaggtaaattggaatggctatgtatcagcaatattcccctaaagacgttgtatgtagctggaatggtattgccattgaaggctttgccccagactcattcttgcgtctacagagaacatcaccacttgtgacaccagttgttggtgcaggtggtcaggttgctctgacaagaaatgcagacaagacaggtactattgagattgagctaatgcagacttctctctctaaccagatgctttctgcaattcaagctaaacaagacaatatggaacttgaagtagatatctcttctaacttcgtaatctacgacccatcaggctctgttctggcaactggtattaatgcttggttgcaggagttgccacagattgaacttggtcgtgaccagaactctaaaacttggatttttggttgtgagaagctagactatacttctacaattccagcgtcaagtgtttaataaatcctataagggggagactttaaaaggtcttccccttttttgtttcttttaaaagtattaaggaatcacaatgaaaacagaatttagagtaattaatggtaagaaagtaaatatcgttctgcttggggcaagagatggtattaagatgtctatgaagttgggtaaaattgttgttccaacctttgcacagatgctatcaagtctgactgacaaggataagaaggaagctccaatggttccatttaaagaacttgttgaagcttgttttgacagaattgaagagattaaccttgaagaaatggcaactctgttatttcaaggggcaactgttgatgacttcccacttaatattgatacgtacttccaagcaaactatggtgagttcattgattacttagcatttgcgctggaggcaaacttcggaagttttttcgaagcaagcattttcaaaagcctaacttctcagtaaacatgggcaacactctacagacaccactaactgatgctgctgtagaggcaacctatgaagaagcagacgagatgaaatttgtgcttgctatttatggtatggaagggtgtaaagaaacacttgaccaactctttgctatgacattctctgatttattatcattgagacaatttcttgaaattcagaggtcgtataaagaggaaattgcttacaacgaacttagaagagcaggaaaaatgtaatggcacaatatacagttgatagcttcattgtggaacttggtttcagtgaaaaggttattaagggcttgcaaagagttgagaagatgtctatgcaagctgctcaacgtattgagagaaatattaataaagcctttgatgtgaaacctaataaaagctctcaggaagcacttaatagaattgtaaaaaatgctcagtctgcttcgggcagaatcaataaagcactcaacagttccttgaaccttgattcacaaggtgttaaatctcttaagaaacttgaaactcaagcaaaaaagactgcaaaaggtattaacaagtccttaagagatgctatgaatgttgacggtaaaatcactattaaaacaggcagagggagaggtggacagagcatcccccctgttggtggtggagcacccagaggtcagagagtagatgttgctcagagacaaatggaaaggatgtttaataacaacttctattcagggttaacccgtagactggaaacaattggtggtcaaggtaaccagatggcagcctctttcagagggagcttgcaaaatatctacaacagatacaaagggactggtaaggttggtgagtatgagatggaagttaaaaagctcatcgacgtaaccaaacgttgggttattgcagaaaatgctagattaaaatcagttaaagaatcagcttggctacaggatagagctaacgcatcattacgccaattagttggtggatttgtttcagcttacgctttactggaactatctcaaaagactattgaagctggtgtaaaaagacaatctgcacagttagcctctacagctatctttggagcagatacacagcaagctagaatgttcgctgcatcattcgcacaccagattggtcagaactacacagacactatgaagcagtactcaaactttgctgctggtgctcaaccaacacttggttttcaaggtactcaagagttctataagaatgctgcaatgtttgcccgtatcaggggtgctactgatgaagacttgaaaggtatcatggttgcattccagcagatggcatcaaaaggtaaagttcaggctgaagaactccgtggacagttaggtgaccgtttagcaggtgctgtacagctattcgctgatgccattggtaagaccccacaagaacttgataagatgatgcaagatggtaaactgcttgctcaagacgttcttcctaaagtatctgaaagaatggctgaacttgtcaagcaagcaggtggtatgaacgctgtatctaagcagaccgctacatcaatgggtcaagctaaggcaatgtgggataacacacttgtagcactgtttaacaactctagtgagggtatttcacagttatctaactctgttgcaatgttcttacaaggttctatgggtagcacacaagctttgggtcttgtgattgggagtctcttaaaaggtgctagtaatctacttgacttcgttacagacttcatgtacagaacatctgcactatactactatgcaagagcttggtataaagaccttgacaacagccagcaaaaacttatcaaaagtgctggtgaatttctgggaacagttgtgacaattggtggtgcagttgctgtagtatcaaaatcagtcaagctcctaagtggtttggttggtggtggtatctttggtaaaatcttacaaagacttggtgttagtgcagcaggtacagcagcagccggagaagcagccgcagcagcaggtggagttacagcaacgagaatggcacttggtactgttggttcggcattaatgctaagaggttctacagacccaaatgctgctaaaaactacagtgaagttacattaccaaaaccatttgaaaatgctgttgcaaatattacaaacccaaaaagaccaatgttctttgatgagaatggtcaacttcagtttgcacagtacactcaagatgttgaaggcaacagaaagttaattgacaatggcctatctaattgggagattatcatggagaagctatcaacatccattgataattttgccaataagtttaaccagacaccaatgatgatgacaccttctggtttacctatgcagactaaacaaaccctgaatgttactttcaatcttgatggtaaacaaattgctactaagatggtggatattactgacaagaatcaagaagacattcttctaagttcaagctatccagaggaagaataatgttatgggattctaatatgcaaatcaaatatagtggcaaagatggcatctatttccacttaagagataatgtagatgccttcttaaccttatcagctactgaaaacatggaatttgacagccctatgcaggtgactacacagaacatgcaatcagggcaaactgtcacagataatgtgcagagagcacccagaacaatcactatcagtggtgtcgttgtagttggctatgaagggagcttattattaactcgtcagggtcaattagtagaaaacttcattgacactctggaaaactggcgtgaccagaagcagattatttcagtcatctgtaaagatggtattaaaattgatgattccattattacaagttttaaagcctctaaagatgttggtatttcaaatggtctgagaatccagctaacttttcaggaaattaactttaaagctattgtagggcaaactgatgtttcagcagctactggaaagaccgctaccacgaatgatggtggtgctaccagtaaaaagaatacagggaacactacgacaagtttaggtaatggtaaattaaactgtcagctactatttgacctagatgctaatggtgtaagggaactcactagtgctgaaggtaatgcgcttgggaaatgctcaatgtctgcgaagacaagaaaaggtgtcaccacatttagtgacgaggctgaaagaaatgctggagcagcgttaaataatactgctggaactggaaaggcattacaaaagcattcagtgaatccgaataagaaggggacttattaatgtcacaatatattcctgttcctgatacagagtggtctacacaaactgtaactctggatggtactgtctttataattgagttaaagtataaagagaggcttgacagatggttcttgacgctatctgatgttgatggtaatgtattattatctgaaaagaaatgccttgcagaccagtcaatcacaggacgctatgtaattccttcattagctggagagctttttgttgaacgaatgtatggtactgatttacaacctaccagaaataatttcggaagagaaagggcatttgagcttaattattacactcaagaagatatgagattaatggagaatttataatgtctgtaaaagatagcactgctggggcttcttttaggtgctatcaattggctgtaggtagtgaaactacagcctttaatgataaacctacaagccatgccaaagattctatgcaaatggactatttcgacaacttacaattcacttgtaacgtgtcttatacgtctcagaaaaataaagtaacctccgatgacaccacttttgaaatctacaacctaaataaagagatgagagccaaatttaaaacagttggtgcaacagttatgctcagagcaggttacaccactggctttaaaagagacgcaaatggtgaccttattattgagtatgacaacctcccattaatttatctaggaactattgaatatgcttatacatataagcgtggtgttgatatggttacaaaggtcatctgttccaatgataaaatggaaagaaccacgattaagacatcaatctcttataaagcaggtacaacacgtaagagtgtaattagagatttagtcaatagattaggcttctcacttattgatgaagacctttcaagtattgatggttacacttacaagaatggttttagtgtttggggaagtgttgcagaggcacttacaaaggtttgtgaagaaagtagtctacgttggtatacatttaacaagcaaatcagagtagtcccttttaacgctaaggctagacaactttcttgggaaatttacccgtataatgttattgattctttgcaaggttactacagaagaactagaaaggttctgaaaaaagagaataagacagttattaaagttaaaactggagttcgttgcaaaatccatttagacgggagaattaagatgggtgatagtgtcacaattagagaaagtgaagattttgaaggtcagtatcgagtaaaaggtctttctcataatcttgactttactggtggtgcttggacaactgaactagatttagagaaggtggaataatgaagtcaccagttactagaatgtctgggtatgtttcagaatgtcttgatgaatttagaaaagaactgtatactggcttaccagctattatccagtcttttgattcaaagactcaaacagccactgttaagccactttactctattaacggtttacctatgccagagattactggtgttcctgttcaatttccaagtggtggtggcgcatctttaacattccctgtaaaaactaatgacagatgctggctagctttctcaatgttacctttagatgacttcgttgtcaatgacaagaatactcagatggaaacaaatatgagaaggacacacgatatctcagactgtgtagctttcgtaggcatctgcacaagaacacagaattttaaaccagacccaacagcagtcagacttcatttcggtgactctgtgttaagagttacagatgatggcaatttttattttgaaggtgatgtacacatttctaaaaacttgtacgtaacagaagaagtacatggttcagattttatcagtgacacgactggtgtgagctttaatgaacacacgcaccattattactggacagaccctgctggtgaggctgatactacagaggcacaataatgaaaacagattttgcattaaatctaggtggtgactatgttgccactttaggttcagattcagtgtatgtggctcatggtgatttaaagattactggtaaccaaattagaattatcccagaagatgataaagctactcaggttgctcaaagacttcatatcagatgccttttaagggctggtgaagtcttctttaacacatctgctggattcccatatttacaacttgccaaatttaaacagaaaacttctatctttgataattatatgaaagcttaccttgttgaaacaagagatgtatccaatatctataactactcgtcttcaatggacaatgctcaaagaaaagtaactgttaattttgatgcaactactacaacagatattttaacagacattacgcaagaggttaatatctaatggcaggattaactacaacaggattacaaactctaagatatcaggaaatttttgataatattaaatcaagacttcttagagatatttcaccaaaccttgacgtttctgaagatagtcaattaggtctctttctggcttcaattgcaaggtctttagcagacacccatgaagtcctgtcagaaatttatgatggtgggacgattgataaagcggaaggttttaacctcgatgatattacagctttaaacgccgtatacagatatgtggctcaggctacaagaggccaagtagagtttactggaacaactggtgcaacaattccatctacaactagactaagaagcactgctggtaatatcttctatccagtttcaaacattacattaacaccttcatattgtgttgaagctgttcttgaagttaactctttacgaactgatgcagattatgttattattattgataacgttattttctcttatcagccaaaatcttcagatacaatcacagtactattaactgaacttgccgatgcaatcaatggtggtatcgtagcaaaagccgaagttatcaatgacggttcagcattacgagtttataaagatgaaggtgacattattgccagaaccaaccctatggtggtgactgctacgacgttccttacattcacaaaaattacaactatcaatgatgttgttgctgaggaagttggtgcaatccctgcattagctggaacacttatcgaaattgaaacaactgtagatggtcttgacagtgtatacaacagatatgacctgacaacaggtagaaatgaagaaactgatacagaacttcgacagagatatttagaatctttggcagttactggtgtaggtactcttgatgcaatcgtagctgctgttaaaagagttcagggtgtatcagatgcttcaggtgtggaaaatgatactgaagagacaagttcagaagggcttccaccaaagtctttcaagattgttgtagttggtggtcaaaatgataatgttgctcaagcaatctgggacaccaaacctgctggtatcagggcttatggagctatctttggtacagcttatgacttaggtaacttagctcataatgtctattttagcagaccaacacccaagtatgcttttgtcaaagtatcttattctttatatgatgaagagagcttaacaatcccagaagaagatatcagagatagtattgttcaaggtattaacgcttacggtagaactttgaaagttggtaatgatgttatccctaacagaatctatgggtatatttatgatgtcattaaaggtgttgagattaatgaaatcaaagtagctctttcaaataaccaatcagtacctcctagtgatgggcagtatactacggcaagaattactgttgatggtgaccaatatactgtatgggaaagtagtcagtacaccattgctaaggagtaataatgtttcagaaaattgataacgtttactataagactcttgatgaaaggactgtaacacagtttaaagataagttcatctacacaagcttacttaaagcgattactgatgagttgcagacattggaagatgtttcatggcaaatgcacactgaaaggaatatcagaaaagctgttgggcagcaattagacaacattggttcattaattaaagtgccacgaccacttggtgctgatgatgaaacatacagagcaatgctgtatatccaaatttttctaagacgttctgacacaactccaacgtttttacagaatgctatcatgactctgtataacgcaacattttcacagatttttgagcatattacacctgtgactgctggtattgtagtcagggttaatacaagaaataacgtcattgatacagcgtacacattagcaaaaattgctgcaacaactattggctcagcagttattctaagagacgtaactctgaatggtactgcttggacacctgtagaggtggctgactcagccttagcaattgttgatgataaagataactggttcgttacagatgctaacaagggtcttgttactaacaacacaggtggttctttagataagaacttactaggtagcttgacagatgctggcgtaagagatgcttatttcgaggttgataggacggctaatagtggctcagtagattacttaaaagttaataaaaattataacgctacagataactacatcgttggtaaagaaactgcagcaggtggtgattatggtgttatggctgaagtagctcaaatcatcaaaggtagaaaagataaatcacagcaagaaggaagttcttaatggcatttttaaattggtctacagatgaagtagatgctgatggtaaccagctaaaagtattaccaccaccagaaattcaggccactggtttattaaggggtgagcctatgggacgccaatggtttaactatatcttaaactatctcctgaagaaagcaaacggaactgttggtgaagtaaggtcttttgccactgagcaaccagatttagtagctaatggctggagtcttattaagaccgaaacaggtactgcatcaacaagtacaaaaaacctttacacttatgaatttgtaggagcttaataatggcagtaggtgaaattcaaattagtgccttgcctcaagcagccttaccaattgaccttagtgatatcttccatcttaagcagggtattgaggataagagatgtactcttgagcaattacttgctccacactcaagcctaagaaataaccctcacggtgttactaaaacacaaattggtttagataatgttatcaatgctcttcagttagttgctgcaaataacttatcagatgttgctaatgtcactgaggcaagagcaaatctacagattatgtcttcagaagaggttaatagccttgttcaacagcatattaatgataaaagtaacccacacaatacaactaaggcacaggttggtttgagcaatgtccagaactgggtgacatctaacctttataatgaggatgcagataagtatgctacagcaagagcagtaaataacttgtacaaggctgttcaggcttcttatccagtaggtactatccatctctctatgaatcctgcaaacccttctacatatttaatttgtggaggtacttgggagttagtttcaagaggaagagcacttgtaggttatgatagtgattctaggccagttggtagtaactttggctcaagtagtgttagcttatctagtaacaacctaccatcacatagccattcaatctacctaactggtggtggacacactcatggtgctgctattactattgatggctttgattacggcaataagagcacaaacagtttcgattatggaacaaagaccactaatagcactggtgctcacacccactcagtgagtggttcaacaaataccacaggtaatcacacacatactgtaggtggtcgttatggtggtgactctatcggtggtaaaccgcgtgttcaggtatctggtacagaacaggtttccagtgtagctggtgaccactcacacactattagcggttcaacaaataccacaggcaatcaccaacacactgttgcaattggtgctcacacgcatactgttgcaattggtgctcatacccataaaggcacagtaactttgcagtcatctgagcatactcactcaggtactacaggtactacaggtgctggtcaagcattcagcgttgaacaaccatcctttgtggtttatgtatggcaaagaaccgcttaaaaattcttttacagggggctgtacagccctctttctagaggacaaaaataatggcagattacaaattgagtgaattaaactcaatcgatacaatccgttcagacgaccttcttcatgtcagggttaaaaagagacctgaaatgctgggtgatgaagaccgtcgaatgacctatcaagacttcttagcatcttttaagcttgaaagatttgttcagattgctggtagcactatgactggtgacttagggattgttaagttactttatggtggtaaggcagtctttgaccctacaggctcttctgagattactatgggggatattttaaagacttttaaaattaacgcaaatggtcttaaattaactattgcagatgcttcaaggtcagcaactgtttatcatactctgaataagccaagtcctaatgagcttggtatgagaactaatgaagagaatgacgcaagatatgcaagacttgctgttacaaacacattctctgggactcagaacattcaaggtgatgttaacttacttcgccttagaaaccaaaatgcaaataatgcacaatatattgaaggtgtagacctagatggctcggctagatggttggttggtattagcaaaaatggttctgatgcagtgcagttgtacaataacaaatatgactcagctttgactattgcaagcaatatctctgtgaataagtctctagcaatcactggtcaagtacaaccttctgacttctctaacttagatgctagatactttactcagacagcagctaatcagagatttgcacagttagctgttaataacacttttacaggtgctaatactttcactaaccttgttgttaagaagaatgctaatgctattactttgcagaatactgatgcaggtacagcactttatattcttggtaagaagtctgatggaacaaataaatggtatgttggtacagattctgatgagacacgtctgaatatttataactacattacaggttcacaggtttcactaggtactactgttggtattaataaaaccttgcaaatcaatggtcaagttcaaccatctgattggactaacattgactctagatatattccggcagcaacattaagtacaattgcaagaactaatactctcaatacattttctgtacgacaagttatcaactctgatggtgaagctcttgcgttaaaagcaaaaactgaaacgacattgttcattagggggtgggctgctgatgggacagctaagtggtatgttggtaatggtgatgccgataacaataataacttaaggctgtttaactacaaaacaggtaaagtgcttaccattggctcaacattcgaaatgaatgcaactttagcaatcactgggcaggttcaaccttcagattggtctaacattgatgcgagatactacaacaaatcatctgctgataacagatatctgagagtaagaagcacagatttcaatactagtggtgctggtaaatgggctaagattgcaactgtgaatatgccacaaggcgcatcaacagcagtgattgaactgtttggtggggctggatttaactttggcctaattgaccaagcctgtaagacagaaattgttcttaggacaggggatggtaacccaaaaggcttaaatgttgttgcatggaaaaactcaccgaataatgatgtaagtagaattgggtatgttaatacctctggtgataactatgacatttattgcgcagttggtaactatctagtcgctacaacagctagggttcagtcaacatctaatgcaacagtacaactgtttgaggctccagagacatctgacaacgctccatctggctatgttgatgggacaattgctcactattacactagtctcttgaagccaacaccttcagatattggtgcatatactaaatcagaaactgaccagaagattgcagaagcgattagtgactctacagacctgaataaaatctatccagtaggtattgtgacatggtttaacagtaatgttaaccctaataccgcacttcctggattaacttggacgtacctgaacaatggtgtaggtaggacaatcagggttgcagcagctaatggttcagatgttgctacaactggaggctcagattctgttacgttagcagttggaaacttaccttcacacactcatagtttctctgcgacaacctctagctttgactacggtactaaaaccactaacactactggtgctcacacccactcagtgagtggttctactaacaacactggtgctcatacacatacagttggtggtcattatggtggtgactctatcggtggtaaacctcgtgttcaggtatttggtacagaacaggtatctagctctgctggtgctcacgctcacactgtatctggtactgctgcctctaacggaaaccatgctcacactgttggtattggtgctcacagtcatacagttagtggtaacactggtggtacaggttctggttcagcatttagtgtaactaaccagttctataagctgatggcttgggtaagaactgcttaatcccttattgactgattgttaagatggtgttaatattctttatgggtattctcaccatcttggctgatgaggtgattaaatgcctacaatcctagcaattctcctaaaaaatctaggtagcttcttctggaaactcattttatcccttctaagtgaatacatgattgagaaagtgttctttaagcttgcaagataccttgcgggtaagacagacacacctattgatgatgagttcgtagataacttagaaaaagcttttaagggggagaaataaatgaagtggctagaggaagcttttaaaaataatattggtgcaattgttgttggtatttttagtgttattgggatgtataccacgatgcaagtttcaagtggtaagcaagaagtgtctgtcacaacaaagttacagcagctagataattattccagaagtaactattcagctattcgtgatttacagtctgacatgagactgattcagctagggatggagaaccagaaagttcagttagagaatgttaagggtgaaaacgcaaaacttaccaaaacccttgataaattctctgacagtgtaaataatctggctcaatcagtatcagccctccaagctattactgagaagaacacaaaagaacactgaaaataaaattttaaggctcctttttacgggagcctttttgttttacttacctactgacaaaggtgcttcaatcttccctgcgtgtttgtagttgttaataccaccaataaaatcactcgcagtaaggtgttttaggtcacttagcgtgttaagtggtagaccaatctcaaaagttggtgcatggaactcttcattattcatcaattcataaacctgcttcatatggttctgataaatctgagtatccccaaagacacctatcaagtatcgtggagtgtacccagtcatcttgcaaagtacttccagaataaaaccataagatgcaatgttaaacggaagtcctaaaaaggtgtctacagaacgttgataccattgtaagtcaacttcaccctcgttagtgatataaatctgaaacagaacatgacaaggtgctaaagccatcgagttggatgcaatatctgctgcattccaagcattaacaagcatgtagcggtctgtgatatcacctttcatcttcgttactaaggtctctaactggtctacaacacaaccattatgaccttcaaagtttctccactgaaccccgtagattctcccacctgcatcttctaaccaatcttgttcagaagaataattagagcttaaccagcgtttaaaatcatctgaccagatagtccagcgttctccatcattttcaccccaagtacggtaacggagttcaccaagtttattctcaccgttcaggaaccataaagcttccccaataacttgccgtgtaaacacctgtttagatgttaagagtgggaaaccagtacgcatatcaaaacgaaattgtggtggagcgaatgcagagataacatctccagttcgtgtagtacgcagttcaccaacggataaaacatggttcaggatatttttgtaacttgaatctgcttgtgacatatcaaaagtgtccttttgcttgtggaacataaatttcaaaggttgctttaccatctactgatggttttgactgaatcttagcgaaaatttgacggtcatgcaacttatcaaagaaattctcaaaaggtagatgcacagttgcctcttcagtcacttcatgaaaaactgtatggaacactacatcagcatacggtaaagcactgacaagaatacctacaccaccaattacgaagacgtcttcttcaatattactatcaagatactttaaaaatgctccaaaagaatcttgatgagccttagcaaatataacatcatctttggtgaagtccataccataataaggcacagaatttgttaagatgaggtttgtacgttctggtaaaggtttactacccagagtcttaaaagtctcattacccatcactactaaattatctttagtgagtctcttaaactcttgcatatcctgtttatgtcgaggccacggcataccagttggagtaccaaactctccattttcaccacttgcaaagattaatttaatcattttgtaaaccctttcttaatgaaccagttgataacattcttcacagctttattgctatggtagattaagtgcggtgtgggttggtatgaaccataagcccagaatgatagctgctcaccacaatcaatacatgtcgtactctcttcagctatatgaccattaacaatcacatgaacttcaccttgcaagtctgtacacccacaatgtggacatcgaataggtgttccatcagactcatagcagtgttcaattttcatctatttaacctcaaaaactggctcaagaaccaatataaagtctacacagtcatcttcttcatccagaataccatcaaagttcttaggaatgaagtcgaagaggctcataacaaaacagtcagaagtgaccctgatagttcctcccatgttctctacagttaacactgtacgactttcttttacctccctcagaagattactcacaaagtcatctaagaaatacttcattagtgacttgaaacctttagggtaatctgtaccagagtatgtttcaatctgtggtacaagcttaacatttatactagtctttgttaagaacgttttagagaacatactatcaggtaacttacaaacagtctttccagtaccttcatgttcaatctcaacaaaaccagcttcgtcgccacatgtgactattttaaaagatgcttcattctcatgctgcgaagccataaactttttaagcatcactttaaggaaatctgcatgagcatcttgtaagtagatatcaatcatagttaatcacctattatgggaacagacacttgatgtcatcgtttttaaaaacaaaacttgtgtagttgtgaccatcaacatccagccaaacagcctgaacatctacaccatcaagattgtggtaaagctctttgatgaagtggtctttcacaatctgactgctagttgtttctagcttaatgtttgagattgctgaacctacagccatataacccatgacacgtttcttctcagtatgcttaatcttaccatctttgtaagccataatgagattggaaagaatcttcacaccataatacttctcaaggtgagtaggtacgccataaaaacctaatgcgaagttttcaaagtggataatgttttcacgtttcatattaatctgccaaccttaaattgaaattaacaccaaatttttcacacactcccaacatatactcaagggaaacattcccagtgaggtggattatgttggatacacgagcctgagagataccgcaaattttagcaacttgttcttgagaaagacctctggatttaatctctctcttaaaacgatgtgcaacgaagtctctcatttcgtctacatccattggacaaatataactctccatttcagcctctctatcagcctcccaatcatcttgtggggcataagggtcaaaaacatcattcatctttcttcttccgtttgcgtgaagtgtcaatcaatgaatctatgtttgtagccctaaccttttcacgttcatcgttaagataatcatcaagaaccttttcaatctgtgaatcatcttgacagataactgtaaagactgtaaagccgtctgtatcatcaattatcttaccataaccgcttctgggatgtaactttttaagagccatatcaaatacctgtgcagcttctgttttctaagaaatactcaacaccatacatagctttttgcatcaaatcttctttaaactggatacgatggttgcgcatagcctgtacatcaatatcatcatggtgcttctctttaatatttgcagattgcaggaaatactctccaagaacgcgatactgatagtcagttaccttatcagtcatctctgttaaagactcttcagagattggtttcagtagctcaccattagctagagcaagacctttaacaatctggcaagtgtcttctggaacacctgataagtccacatttggaagttctgttgcattgactggtaaattcattgccataaccattgcagcagctaataaaatctttttcataatgacctcaaagttatattaaattttgtattacattgagtataaaaataagctataacacctgacttgtcaacagattttatagcttatttggcagattttttataaggctactgccatccttccataccagactacgccatgccagaccagacttcacatcaccttaccgtgcaatacatcgcttaaaaccctcttagaagactcttaagtgatgctggtgagtacccgttggttcatgctgctcagtatactcaccaaattttctatgtcaacaactttttattcgtaatctcgaataactagcccaacagggaactgtaaagaccccttacgagtcatcttctggaactgaaccgtcaaaggtttcccgataaactcttcaggatgctcagcaagatactgtttcttctcatgagtagtcttccatgagacatctacaaagacgttaggaagagtctctacaacgaacttaccatgaccacgtttatcggtcttgacaccagtcactttaaactcttcagtgtgcatcttcttgtgcttaatcaagaagtatgaacggtgacaacactcatagaaggagtcttcagagattgaacggtacattgcaccttcaaacttagcttcaacccacttatcatgggcttcgtcaaactcttcccaagaatttacacggatagtctgtacaggaaccactctacaggtatcaccaagcccaacaatgggtgagttatcaataacttcacgacgctcaggccaagattttgaattgtcacagatatcataccagtagaatttaagaaggtgacggtctggattgtcagcattcttaatcatagatacaatatcttctaagtcccaaccatgagcataaatctctccatcaaagtcttcaacttgtggatgtaatttaagcaacaaaagtaaatctggaattagttctgctggaacgttgtaaacagtattctcacgagaataagctgtgaaaccgactgaatcagcatctcttgaaattctacaacggacaccatcaagttttggttgagcatcagcagggaacttcagatactttgcatggctaacctttgcagcatcatgagcaagctgtacacctaccttctcagtattctgtgcagactcttttgtgtaagcgtaacctttacggtctacttgtttcttgtacttagcagaaacttcaaagagagcttgctgttcagcgttacgctcattctttttaccgatgttcttaggctctgctgtgtactcttcaaacatcatcttgccattttctttaccgtaggttgtgataactttgtcacctacagcaacgcatgaccagacgttgaaggaaccatctttattttgtttgtataggattgtcatttttaacctctgagtgataccaagtattgcaagcattacatgcgtaaagctctaagtcatttttatctggtttatggaaacagtttgacccacaacgacaccggaatagcttaccatcaacacgaagaatgaatttttcaagctcaccatcttctgtaagaactgcgttcttaaatttatcttctacagtcattttctcttaccaccaatctctacgtcgataacttgaacatcaccagcaacatcaaacttatgaatgatgctttccacagtgtaagtccaaccatcaatgcgaaccagctcaccttctcgtgggacgattggattacgttgagctatggttgtagtggagtgaacaacatcataacggtagatatagtttactaggacttccatcgtgaaaacctcactcaataaccgtagtatgtgattgaccatttttgccgtagctataagatgttgttgtttgagagtttggacatctgacaacaacaatatccctacttatagcgtcaccattgagtttgtagattttgcagtcttgcatctctggagggaggctataagaggcgtctttgttttcataagatgggttacagccagccagaaaaattactccaagtgcaaccattgctttcacacaactcttaaccttattgttcacgatagtctacctctctgtatgtttttaaatagtgagtgatgagttctggtaattcactacgtttaacgtttgaacgaagaagtgtccagtcaaaacctttaccaacccttccccagagactgtacattttcttcatagcaactccagaatatcaatacgttcacctttgagtactccagtacggtctcttgcaatcttaccatcaacaataagaatgtgcgcagactttaaagagtcaccattaaaaccttttacgaacttactaggcatcactacaatggacatctcctgaatcaactctggagtatagcaattgtcgtgaagttgctgaataacgtctgcaagtgtcatttttgatgtctccaatactcaatgtcaataagttcttgtgcaatgctttttagattacctttcaagaaaaccttctcagaacctgaaagagatgaattgtcaattaacctgttcattctctcaaacaacttctgcttacggttcttgatagtttcctttgaagcacctttcatcattgctgcatgggttcttccacggtggctcataagccctcctatacaagatatagtataaggtactcttccctgagcaccttgtcaacttagttttgcaaactctccgtggagtttaatagcagcttcacagtaagctttatgggcttcttcaggtgtgtcaaacataccaagatgatagtttttaccttgtaaacgtatcattgctcgaaaccttttatttatcttctgtacaccttttggcaacccagattgggactttcttgaccgattgcaagagttttgtgaagctgtacaaacccttaaattcaagtacctattgtcccaaccgtccccattcttatggtcaacctgtaaggttttatcaggcaaatatccatccacatacaagataactaaacgatttgcttggtaactccttccatcaatcagcaactgaactgacttgtgtccatcagtatttgttctgtagtttccagccctcttacctccaaatctagagttaaaatttgcattaccttctctaaacttccaagtaaagacccctatttcggggtcgtagtccaatagctccttaagacgaatttctgtaatcatttcaacaccatcaatgtacctcataccagctcttaccaaccttacctgtgccagttacaagcgtctcactcttcaaacctaaattcttagatgcctgaccatacatccagtcagttatggctttaacttcttgagtcatactttctgggcattcccaactgttctcatcgtggtatgccagcaaaagtctagcaccaattgctggtttccgtccatttaattttgtcaacccttcttcacatgctcttctacaagcaaggttaattgcctcgttctgaatctgactttccgaacccatgagcaaataattcaataacttatgtggagatttacaccacaaccaagctccagcaacctttacaaaaccccctttagagattgcagcagtcttaccaaacacctcttcaagtgcctttttagttgctttgtagtcagcttccaagtcatctagcaacttcttaattttagggaggcgtacaaagtaagtttgcttagttaaagcaccttcttcggttgttgatgctttaatcgtcttagcaaacttctcatcacctgcaccgaacaatacatctggtcaatacactcgcaaggtgtaccagttctcttatgaacttctccgcatttctacggagtgtcggactatatcacgtagtagtaatactaccgttgcacttgggaatggtcattagcttaccaccctactctactcagttcatacattaagtatgcttttcgatagtctctgaacgtttctctgttaggaatctctatagttatgttatttgctttaggagtcctaacagagacttcgctgctgattaccatatctttacagacttaggcttccagcaattcacaacgttttacatgcgccactgacgcataaatgccattcttagctttcttacgacctttgctaatctcatgaagaagattctcatcctgagtagctcgacaagtcaagatgtcctgctcatcgttcaagctaaagtagatactgttcagtgtatgtgcatcagtccctgaatagacaacgtacaggtcattctcagagtcatagcgaaggtacttatcaatctctgggttgaggtactcatcaaagtgtttgcagtaatagcgtccatcttcttgacgaatgaactcaatctcttctttaccttgtgttaccgctttggtgaagtctttgtcacccataaagttacaaagaagaactagctgggctgagttcatatcaactgaaacaatgttagtcccttcttcacaagtccacacctcccgcataggtgctccatagacagcagcaccagatggtacgtttacaataccatattgtgtcatacgcccagttgaagtaccaaacaccattgcaccagcactaaggcgaccatcaggacgaatctggttcaaccaacctttttcatcatcctttgagttctcaatagttctgcgtctgtgcatcaaagtatagtatttagcaatcttctgtccaagctcaccttcaatcgtatcataagatgattcagtaagttttggcgaagtacggattaagcaaggctcaagcaaatctgtgtacttcttcacagaccagttatgctcaatgtactggacaccttcatgttcaacataactcaaaccacaccgctcaaccatttcctgccacttaggatgttttgtaatcatctttttattgtctttgaaacgacaaactttgacaggacgaccatctgagtctttcttgtagttccagtcatctggaatccaaccaactgatttcaagtagtctttaacaactgctacctgagtcatacgagaaacttcgaactcaattggtgtatatggtgcatcaatcaaacctgtgtagcgacttgactcaagttcaaagtggttaacgacgtggctgttatagtacttcacagttttgactgtttttactggtttccagtctttgcatttcttaccaatctttgcgttcaactcattgcaaattgcacgagcatccttcattgctacaaagccttccttgtactcttcaccagttacagtgttggttggtgtatagcaatttctcttttcaatgttaaaaatctttgtagttggcttaccaaatggcttgatttcataagtttgcatctcaccgttacgtacctgctgacgatactttgttttagggtacttggtaattctcttcagtccatctgcatgaccaaatgtttcaacatactcattccaagcttttgcaaactcttctccagtgactttacctttggtcttaatagttggaggaagatgtggttcaacctctgaagcaagctcattagtcaacttgtcaagttccttcacatggaactccataagctctttatcagctttccaaccattgatagcttgttgactcatccagaaagatgtttctttagctcgcatgtaggtttcataagtgtctatgccacacttcttaagcttgagatactcattatcaagtgcccgtttagttttggcgttaatacggatatcttctacaacacgagtgaagatttctgcattccacacaccccaatgctcaatctctggtttacgaacaccaacacgagcaccccatgcagccaaaccatgagcacctttataaccctttggagttggtctatccatccactgaacacgagactggataagagaatcctgaaagaaattactccacggcttacattttggattatcaaagttccataaatccggtgcaatgtgattgaagacccaccagtcataaccgaggccgttatggatacaaagtcgttttgcctttaacgcaaactcaacaccttcacgtaaaccacccttaatgtacttagtgtacttgtgaccgaggataggctcatctgtaaagacccatacaggtggctcttcatcgtcagatttatagtctgcaaaggccattacgtgaactttagtgaactcaaggagtaaaccatcagtttctgtatcaccaaccaaatgtaagtttttaaaatctacgttttccatttttactccctctaaaatcattaaccccatacattactgcaaaaaattataaaaagcaagttgacaatacacttgacaaggtgttaatctttgcgaagtgggtttttacttaaaaggttacttaacagtttaactatacagatactttaaaactcttaaaagattatttaatagcttttaaaaagctttaaagtataacgtatagaatacgttaagataaaagattaaaacttaatagttacttaaaagaggcttacatgcagaaaatgtttgttcacccagacatagctgactttgttagagctttgcagaagttggaagaacttgacattgctgctcaacgggaatatgctcaccatcacaggagaatggttgatatacaacatgaaatagagttgtctgaaaactatgaagatgacttaaaatgctctgtatttgagcatatgaaagatgttgctacagcgagacgtaaagctaaagacacagttgctttactagattctcttaaaaagaggttgcaaagtggtacagacctgtgtaatctagcgtcactgattaacgatgttgaaacttcttgggataggcactattatccacgttctgaaaagacacttgacttttcttcatccgaaaacttaaaatgttctagaaagaaacttaaccaactgagagagaaataatatgaatatcgatgtagaaaagatgcttgaagaaaaaggtattgacgaagcgttcttaatcaatgctgtagaaagcatggctatgattcttcgtggtaacaactacacagaacagtttatgcctgcaagctataacttgcctgaagacaagtctgataacggtgcttttgcagaacaggtcaacatgatgctttgcgacaaaacacttgctttagcatctatcgttgtaggtgttgatgcccttgcagagttcattttttatgagatgcagaaaaatgactatattgccatgaccactgaagaaaaagacttgctactactcgcaggtaatgatgaactaattgacctgttaatttcatcaactagtgctgttatggctgctcttgagaagcgaatggaagagaagttgtcacgatatgaaaaacttgattggggtgtagaagaactaaacccacgaatcaaggagattatccagcaaactaaagagtctttggaagaagctgttgaaaatgactctgtagctgatatagaaccacttcaggtgaaagttgcactgatgattccagctatctctacgatgatgaatatcgttgcactaatccagctttcacagatgatgggtgtgagtattgagttcattgaggagatgactggtggtgttagtatgcaagcaatcaatgatgttttggtgaatattggtgcttcaatcattgaagagaaactacgcattaacttcggtgatgattttgtgaagcaactctcagctatggctgaaaaagagtctgctgagcaactacactaagtctttataaatcttacaagcctccttagttgggggctttttagtaattaatgggggtaaaatgagtaatattatcgcatttactggaaaggcacgttctggaaaagacacctcatgttctattgtgaagaatatcttagaggatgagtacggctacaatgttgaagtaatggcctttgcagacaaccttaaactatctgcatcaaagatatttgacctgacttggaatgacctgtatggtgaaactaaagagactccacaggtttttgacttatcatatcctgaactgatgtcaaaagttacagaagctatggagtttaccttcagagatgaaggttaccatatggacttcaagcttatgtcagagttaaccggacgattgattatggagcttaagaaggttgctaaaccgactctattgacacgtctggggtttagcaaaaagtataaattctcatcaagacaaattcaacagatttggggtactgaagttgtccgtaaagtaatgggcgacaagttctggtctaaagaccttgaaaaaagaatggttagattctatgaaagttgctcacttagaaaccaatatggttttgtcttaatcagtgatttaagatttgactctgaagctgagtggctgagtagatttgcacaccaaactattgaagtaaaaagagacaatgtggataagatttcatcacacgtttcagaaaatgggatttctacaaaatatgagcgtgacattattcataataatggtactcttgcagaccttgagaacaagctaagagccatcattaaagtttaaaagagagaatgaagatgagagtaaaagacaattttaaagttattgaccaccgtttagtggaactctcatctctttccaatgaggtaatgattgaacgtcttaagagagttgaatcacgaaggaaagagattgcagatgaaattcatgaactggacaagattgaaaatggattgaaggcagaactacaacgaagaggtgctaatgtctaaaggtcgtaaattgaaagaggctggtcagtttattggtcattgtgcatgtccacgttgtggttcatcagatgctggttcaatctatcatcatgacgatgattcttattcgatgacttgctttagttgtaacaaaggtttcccagagtgggattttgataaaggacaaatcgtgagcacttattctactggttcagacaataaaaaccgtactttccgtggaatggatttagaagatgtcaaagaaaacctagaagcaatggacttgaaagataggaagattcctgcaaaagtccttgaacgcttaggtatcaaggttgacattgacagtgacggtgaaattgatgcacacttctatccaacttacaaacgtaatgaagatggtaagctagaacatgttggctaccgtgttcgtcaccgttacccagaagaccatccaaaagaacacctacgaggtaagctaaaagacttttcaggtggtgttggagacattaaaggtgaactggcaatgttcggttcatggattgctccagaaggtggtaaccgtctattcatctgggaaggtgagatggaatgtgcgacagcaatctatatgacttctcttgcgattaaggacaagtctcgtcgtaagaattactgtcacgtatctgttccatcaggtgcaaacattaagtctatcaaagacaactatcagtacattacatcatttgatgaaatttacttgtgctttgataacgatgaagcaggtgctaaagccactaaagaggctgctggcattctccctattgagaaggttcgtttattccagtatccagagggtgtaaaagaccttaacgaatggtggacaaagttctataaagagaaagatacagttctggaaggatttaagcagcgtatctacaatgcaccccgttactgccctgctggtatcaagaacttcgcagatggttttgaggcaatgaagaaccgtggtcagattccattgattcctttcccagaatctttcggagatttgaacaggctgacttatggcggttacggtttaggtgagattacaactctggcagcaccatcttcagtgggtaaatctgcatacactcgtgaaatgatttacactgcttggaaggataccgattacaatattggtgtaattcctgttgaagatacctatgaagagttgatggagatgctctgtgcaatccacctgagcaagcagatttctgagattccttatgacgaacgtgattgggatgaattgaagggagcgcacgcagaactatctaaaggtcgtcgtatccacatcgtagaccatcaaggggcaattgaccaagataacttactggagtttgttgactatcttgttaatagcttagactgtaagattattattcttgaccctattacgttggctctgtcacgttcagatacggatgaagaggaagttttgtctgagctattgcgtcgttgcaaacgctaccagtatgcacaagtgaacgtctgtcacgttcgtaagagtgcaggtggtcagaaggctaactctgaaggtggggatatctctgaagaggatattaaaggctctggtgcgtatttccagatttctatgaacaacattctgttaatgcgtaacaaggttgacccagaccctgttaagaaaaacttgacaaaaatcaaactaactaaatgtcgtcgtcacggtaagtcaacgggtattgctggtcatacttggtacaatccagatacaggacgcctcatcaaagcatctggttgcggagttgacattgatggtgcagcagaaaatattcgccaacagtttggtattggtgaagctgaagaccattacgatgactctttgccacattatgaggatgaagtgtttgaccgtgagactggtgaagtctatactgaagagcagcgtcaaagctcaacgattccacctgtattaagtgaggatgcagatgactgcccattcgaaactgagtgatagttataaaagagaggggttcacacccttctttgaagaaaaaagtttaaataaatttcaggaagagtgtttgacaaagattgataggttctatagaatgctcctcatgaaatgcgatggagaggttgagataaaagaagattttcaccagagcatgattacagtcatcattgcgctgcctcagcataatattagttggctgtttataattaaagaaggtgtgtttgaatatcaagtatatcggagaatatcatgaaacactctaaagcatttgaaaaagtttttggggattccttaaaagccactgctggaaaaccagcaaaatactatgaagagaaacgtgtaagaactggaaaaactgcacgtaaagcagcttctaaagataagcacaacttccagtaattagtatttgacaatagagtatcaacaaattagaattggtactcttcataaattgagatagaggtttaaataatgtctaaagttgttaaaatgaaagctccggtagagaagtacaacggtactgaacgtcaaactctgcgttacctgctgaaagatgtctggttttattacctgaacacttcaccacgtccgggaaaaggtaaatctattgataagaaattcccaggcaaagactgtaactacagcgtatcaattctggcagaagacggtaacaaactgtttaaagagtttactaagtctaagaaaaatccagaaggttgggacaaagttactactgaagcagttgatgcagacgacttcgaagagaagtttggttgtaagccaccttttgaagcagacacttactacatcttgaaagtaagtcgtgcagcagcttataaagatggtgctgtatggacagctaaacagtcattccctgtaatgctgattgaagaagtaaatggtaagcgtgtagctgttaagcagccgatgaagaaaatcaaagctcaagcatctgataaacatgaagatgacaagaactatgacgtaattcatccagatatcgcagttggtaacggttcttttggtagtgtgattctttctactcacttctacacttttgagaacaatgttctgacaaaacctattcaggaacagtttatcattgatactcttgtaccttacactggtggtaacggtgctaatggtgaacctgaacttgatgaagatgaactggctatgcttggtcttgatggtgttgaagataacggtgaaatcactgaagaagacgcaacagaccataaaccttcgaacgcttctgatgatggtgatgatgaagatttgccagacccagatgacgaagaagatgaagacttcgatacagaagactaatctctaaaagttactttaaagccctgtacttagtatggggctttttcatatggagagccataatggagaagtacacattaacaaaacttcccgattcagttacacatgtttttattgactctgatagtattgcctataaaggtgcttgtgtagttgagaaagcaaaatataaatatgtcaataaactcacagcagaagaatctgattcgtttgataatgcaaaagatgctgcaagatggttagcagaccagagaatccttgtggaagagcttggcctgacatttgatgaagatgaatgggaaagacagacttggaaagaagctaagagtgaaaaagaagctatcatggctactcaacaggtgcttcaggaatggcttaagattgttggtaaagaaagaacttgggtaggttatttaacagagaaaggtgtgcataaacataaagacattaaaggtcttgagcaccaatatcaagggaaccgtaaagatgctgtcacaccaacacacttagttgcttgtcgtgagtatcttctgtcaagaccagagttcaaattgattcttgatgggtttgaagctgactctatcgtaattgctaaagctgaaaagatgggtaaaaaggctgccttaatgagtattgataaagaccttcgccaagctgaaggcacttactgcattgatatgacctatgaaaaatcacctttaatttttattgctgataacaatgttggtgaaatatgggattgcccaataaaatcaacaccaaaagctaagaagacagttggggtaggttttaaatttctttgctatcaagccgtggctggtgataatgcggataattattttggtttaaagggtgttggcaaggttactataatgaaagcccttgagggtaaaaccacttacaaagagtgtcttgatgcaatttatgagctttatgctaagaaagagtcgtacacttatgtctcgtgggatggtcaaacaattaccagaacacccttagagttaatgcagcaacactttttcttagcttatcaggaaagaaataagaaagacgatttcacttttgataagtatgggtggacaccaaatgttaactcaacaaactcttaaagagcacctgcactatgaccccgaaacaggggtctttacttggttagttgatagaaaaggtaaggccaaagctggctcagtagcaggttttaaacaccatagcggttatatctatataaaactcttcggaaaaagatatgcagcacacaggctggcattcttgtatatgaaaggatacctcccaaaatttgttgaccacaagaattgtatcagatacgacaactggttcgacaatttgagagagtgtagcaggtcagacaacaactgtaatgcagtcaaaagaagagataataagtctggtgtgaagggtgtatattaccacaagcaaagaggtagatgggctgcacaagttaagcataataaagtttgctaccatctaggtctatttgactctgttgctgaggctgaagaagttgtcaaaaagaaaagagaagaacttcatagagagtttacaaatcacggagaagctcatgaatgattaaagttaaaggttttgggagttgtccaacttatggacattggatttcactatgtggtgaagttgacccagcaaagcactttggttttgtctacctagtgtactgcaaaaagactggacagtactatttgggtaaaaaacagcttaacagtgtgaccaaaagaaaagttgctggtaagactcggaagaagatagtcactaaggaaagtgattggatgacttatgagacttcttctgagtatatcaaaaaagatattgaaagctttggaaaagaattttttgacttttacattatccaaacctactacacaaaaggtggtctagtttatggtgaagcaaaccttcaacataagttcgatgtaatgacaaaaaggattgactcgaagctcagactcttctacaatgccaatattgcagcaattaagtttattaccaaagaaacttatgaagatgctgaaaaaagaatccataaggtaatgaaagcaaattgtgcttgataactattgagagagaataaaatgtttaacaaaagtaaagctgtaagtcatgtagcaaaagttgacagcaagattgaagaacttgagcgcatccttgcaaatgctagagggtcaataattaaagaagttgaagctgttgaatctcaaatgcagcacctaatgcttaaacgtcaagagctacgtgagcatctagaatatattgaaacacgagagctaaaggttaacaaatattttaaggagtccgaatgtttaactcaagagaatcagtaaaaaactggaaccttcgttgtggaaacactcaaaagcaaccttacagtgatgagtattgggaatctttaaaatctcaatctctgtgtatgcttgaagaagcaaaagagcttgtaaaagcaattgaagagaaagaccccattgaggcactggatgctcaggcagatttacaatatgttcttgacggcttgatttacctgtcacaacatgaccataacggtgctatgaaagctgtttgtcataataatgacctgaagtacacagatgattatgaagaagctttaaaacgtcttgcagacattgaaaagcgtactggtcaagagtgtattatcagaatgtcagtagttgatggtaaagagtggtatgcgattgttcgtgcagccgatgggaagattatgaagcaatcaaatctccctaaagtacagcttggtgaatacattgtagagcttgaaagccaagaactttttgtggtagtatctgagacatgcgttatctgcaaaggtattgtaggtagcttaaaggatttgggtgtagatggttttgtagaagtcaatccaattacctctaaagcagataaagatttctgtaaagagaacggactatggattgcagatattgtctactatgatggtgagcagttccatgtaacctcatacccgaaactgaattatgatgctaataacctgaagtgctggttaaaaggggttggttataatggattcacagaacattaataaagagggtgtggctcagaagagccacttctcaaactacaatatttctatgacggtgtttatgaatgacccgttactagaaaaatatggtgagactccagatacacttctggacaatgaacaagttttaaaagcagtcctgtacaaatacgggattgatattgagaaagagtattcctttgaaatctgccaacacaggaatactttcggtaaagttgtgatggctccactctttatgggtgtagaaaggactgactatggttggttgtatctaaaaagaaacttggagaaataccgtgtctaaagcaaaaaagctatcttatgatgacattatctcaggtgctaaattaggtgttgatagtatcggacaagatgttaagcacggggacacagttatgtactgtgatgaccgaagaggcagaagtgcaatcttgtttggaagaattgtttgcaagatgcgaggtaattacgttgttgcagacatggatgtgaacgttacacaaaaacttgaaacacttatggatgataatacaccatcatggttctccctgaattgtatgcacacttcttcagtcacaagagtaagtgataagttttacgatatgtggcagaatgagcaaattttcaagatttaaactagggagcctcttcggaggctcttttcatctgtaggattcgaaaatgattaagacaattaaaaaatcaaacggtacagtagtaagctttgacccagaaagactgaataagtgggcatcatgggcagataagcgtggaattatctggtcagaagtcactatggaagccatgaaacgtgtctatgagggttgcactacaaaagagatgcaccaagccatgattgatgtttgtgttgataaacaaactcaagagtactcagatatggctggacggctgcttttgggtattatctacaaagaagcctttggaggctttactaaggttcctacgctggttaccttcgttaaaaatatggagagagcaggactttgggagaagatggattattcacaggaagagcttgaatacctgcaaggttacatcgtacactcaaaagatatctcttacggttatgcagtcttgaaacagttcagagacaagtatggtatccgtgatattaaaacgggaagactttttgagtcaccacaatttatgtttatgggtatggctatgaaagcctttgagaagcaaccaaagcaccgtagactgcaagatgttatcaagctgtacacttacctatctgacctgaagattaacgctcctacgccttatttaaatggtttaagagcaactaaatcaggttatgcgtcatgctgtttgattaaggcaaatgatactgctgagtctctcggtattgctgcaaaggttgcttatgatatgaccacaaagcaagctggtattggtatgctgatggagacacgcactattggtgatggtatccgtcaaaatacgattgaacacatgggtaagctaccttattacaagcttgtacgttcatctgtagaggcaaacaaacagaagagtcgtggtggttcagctaataacttctacactgctctagacccgcagattgaagatttactgcgtttgaagcaccctacaacggttccttctaaacgtattaatgagatggactactcattcggcacaaacgattatttctggcagtgtgttcagtatgatacagattggttgctattctcttacaaagatgcaccaaaactctatgacatgttctacacagcatctgctgatgagtttgctatggcagttggtcacgcagtacattcaggagttaagcacagacgagtaaaggctcgtgaaattgctaagctgtttattcaacagcgttatgctacaggtcgtgtgtatccattcttcacaaataatgcgaacacacatacaccatttaaagaaccattgaagatgtcaaatctttgtatggaaattgtgttgccagtgtatggttttgagaaagagacagacctttacagagacgatgctgtgaaagaggatggtgaggtggctctttgcttcctagctagtttggttgcagggagaatttcagaagatgaatacgctgacgttgcttattatgctcttgcaatggttgactccgttattgaccttatggattatccgtatccgtcgatgcgtaaccatgttcagaagcgtcgttctgttgggattggccttacaaatgtggctcattaccttgcgaagaactacgtgaactactcttcacgagcaggtaaaacaaaacttcatgaactggcagagatgcactcttactatctgcatgaagcctctctgagacttgctaaagaacgtggcgtgccagagtacatgaagttcactaagtatcctgaaggctgggttcctccaaagacagctaacaagaagattgatgaaaagcatgatgcaaaactaagatatgattgggatgacttagcacaacgtatcaaagaaaatggtggaatccgaaactctgtattagaagcttacatgcctaatgagagttcttcactagcaactaatacgacaaatggcttgtacccaattcgtgactttattttaactaaaaagtctgcaactggtaacgtactgtttattgttccagattatgaagagttgaagtatgtctatgaaattgcttgggatattgacacctttgatatgattgattgttatgcaattgttcaaaagttcactggtcaagctatctcttcagacttctatgttgactatgcaaagtctaagaaggtatcattggctcaagctctgaagtacatgatttatgccaactcggtaggtatgaaaaccatgtactaccttaacagtcgcattggtgtaggtaaatctgcactgcaagatgcttattgcgagggttgtggtgtttagttttaacaactatgagggtcgtaaaagaccctctaaaaataactttggagagaccatgaaagatttaatagaaaaacatgagcgacctatatacttgctccacaagcctcggaaaacgatgtactatgtgagtagcacagacatgatgataaaacaaaatgatgactcatgggttgctggtatctcttacatctctacagcagatggtaaaatctatgcaagaccttatgagatgtttaacaaagaaaattgggaagttttagacagaaaacaagccttagaaatgataaagaaaggagaaatcacgttatgattaaccagcacccaatctttttaggtggtgagagaaaaacttttgactcacttaataaacactacccaaaaatctttgagctttataaacaacaaaaagcacaagattggtcagaagatgagttcccttttgaacaatcacgtcttgattttgagagtgtcccagcatcaatgtcaggtgtaatgcttgagattcttaagtggcaatgggaagcagatactcaagttgctaagagcttggcatttgcctttgcaccctttatctctgatgacatttatgcaactgcaattatgaagcagtctgagattgaaaacctacatgctcttacttactcagagattgtaagacaatgtattaaaaaccctgaaacaatcttagatgagattaaccagaatgttgctgtgcaagaccgattaaaaactgtgaatcgtgttcttgaagaattactggatgaagggataaactaccgactgagttatgtccgtgattcacttctggacaaagaccctttacacttccataaagtgattctaaaaggtctgtttgcagtgactgcacttgaaggtatatcttttatggcatcctttgcatgtacctttgcacttgatgctcaagataaatttcagggtattgctcaagctgtccagaagattatgcttgacgaaatccttcacactaaaattgatattgaagttttaaaagaaactttaagagatgatgagtggcagaaagcttttcaacaaattcttccagagattaaagtaatcttagatgaagtagttgaaagtgaagagaaatggtcgtattatatcttctccgaagggcgtgctgtagttggcttaaatacaaagcttcttcatgagtgggtttactataatgctgccccactgtatgatatgtttggcattcccagagattttgtagctcctaaagaaccacctttaaagtatatgattaagaagatggaaattgataaagagcagaatgctaatcaggagcaacagaacggtgcgtacctattgaatactgttgtagatgatttgaatagtggatttttagaggttccttaatgacttatgtaatttactccaaaactggatgccctcagtgtgagactgcaaagaattttgcaaaagctcgtggtattgaccatgttgtgagaatgttagggcaggactatgagctatcagacctgatggatattgcacagatgccagttcgtcagatgccattcatcatgaaaactgatggacaaaacctaaaacctgttgggactctacagaattttatggcagaggtgaataatgcttaaacgcatttgggaaggtttggttgttgatgcaccagctattgtgattggtatgcttattgttaacctatttactgactttgaacaaggttcattgtttggagccatgttactatgggttatcttcgaaatattagagatacagttaggtatcactgaaaaactaagagaactctttgcgaagttttctaaaaagatttaaaatgaaagggtctcttcggagacctttttagcatgtaaaggggcaataatgaacaaagtacagattattaaaaagaatggctcactcgaagaacctgatatcaaaaaagttttagcagcagtcacaaagtcagctagtagggttgggtataaagaactcccaccagatgttacccaagctcttgagtcagcatttatgaggcttctggtaaaatccactaagcagaataatttgctaatttctgtaaatgatattcacagtattgttgagggtgctttggcagaagtcaatcacgagatttatgagtcttactcaacatatagaaattaccgtaaagaagttgctcaaaattgggatgaactctaccagaagaccaaagatacactcttcttaggtgacagagagaatgctaactttgacagcagtttaatttctacaaaaggttcaattattcgtggttatctgactaaagaaatctttaaacagtaccacttaacaccagaggaacttgaagccattgaaaaagggtttatctatatccatgatttaagagacctaatttttggtggtatcaactgttgcctgtttgacattggtaaagtcctgaaaggtggctttgaaatgtctggcattgaatattgtgaaccgaagtctgtactgtcagccttacaggttattggtgacgtagttctttcagcaactgcacagcaatttggtggctttactttagcagagattgataaggtacttgtgccgtatgctaagaagtctctacgctatcatgctgagaaagcaacagcttatggtattcctaaagaacattaccacaactatgtcatggagcagctacagattgaattaactcaaggttttcagtctcttgaaatgaaactaaatactgtaccttgtagccgtggtgattttgcattcacaactttgacattcgggttgcttgactcagatatgtctaatgaagataaccgactgcaatacatgattgcgagcactctcctagatgttcgtatgaatggacaaggtaagagcaagaagcctgttgtattccctaaattggtttatatttatgaccagaagagacacaatgagaatatctgtcaaggccacctgtacagtaaagctattgagtgttgctctaaagctatgtatccagatttcttaagtgtatctggacatggtgctgtagcagaggcttttgagcgttctggcaaggtaatttccccgatgggttaacaggctctatagctcatctaaaacgtgcctaaacagggaaactctacagatgtagacaatcctgtgctaaatgatgtacgatgtaagaaactatacaacataggagtcttacatgccaaactatcacgtcactgaagatggaaaagtctttagggaaaatggtgtagagcttacgcagtggaaatccaacactgggtatatgaaagtgaggttttacggtaagaataatcgtgacatgtatgtccacaggttagttgctgagaaatatgtacctaacccaaataatcttccaattgtaaaacataaggacgataacaaactaaataaccacgcatctaacttagaatggggtactcattctgagaatgctaaagaaggttatgagaacggatgctacaagttccacaagcgttcatatgccgtgaaagccacacacaaagtgacaaaggaagttattgttgctaagtcaatacgagagttatccaatatacttggacacaatcgcaagaccatctcttcaatattgaagggtgtaaaagagcataataacttcgaatatgagtttgaatacatctaaatgccgaacgactaaccgtgatgaatgtagcggtgtagggtcaagcgactcgaaatggtacgctacttagaaataagtagaagatatagtctggacttactggcgacagtaagcagcttgaataaagcggggtaagcttagcgaacttacctgaacaacaagtgtagagcatttttatcaccataccataacgaatatggtgaagagttttatgtaggtcgtgctaacattggtgctgtatctttgaacttaccaatgatttaccagtattctaaagagaatggcttagatttctggaaagagcttgataagtacctagaaatgattcgcagcttccacaagaaacgttacgaaatgattgctaatatgccagcaagttctaaccctcttgcattcacacaaggtggtctgtacaaagggaataagaaacctactgacaaggttggctgggatatcgtgaagtccttcacagcttcttttggggttactgcgcttgatgagctagatgttcttgctgaaggtaaacgacttcatgaagttggaagctgtagttttgcatatgatgttctggaatatatcaacatgaagactgaagagtttaaaaatgaagatggcttcttatatgcagtctatggcactccagcagaatcactttgtggaactcagctaaaacagttcagagatatgtttggcgttatcaaaggcgtttctgacaaggaatactttacaaacagcttccatatgaatgttgcagccgacattacaccatttgagaagcaggacttagaagaacccttcttccatatctgtagaggcggcagaatccagtatgtaagagtggctaatccagaaaacttaccagcacttaagagttgtattacaagagggatgttgaaaggtttctatcagggacttaactttgacttagcaatctgtgagcattgtggcaacagaccaaaggctgatgttgaagaatgtgaggtttgtcattcacacgatatctctgtgattaacagggtgtgcgggtacttgtcattcacaaaaattaaaggtcagtctcgaatgaatgacgctaagatggcagaaattaaggatagggtttctatgtagaatacaaatgaattacgaactaatatataatgcaattattaagaaggcacattctgaaaggggtgtgcctcttacatactacaaatgtcaaggtaagggttatgaaagacaccatatcataccagtgtgtctaggtggcgataaaattagtggagataatattgctctacttacacctagagagcattatatagctcataaattactggttaagatgtatccaaacaaccacaagttatggtttgcatggaacagactagctcatgatggcctagataggaaaatatcatccagagactatgaaaaggtaagggctttgaactcgaaagctttatctattgtgaataaaggtagggttttcactgaagaacatcgaagacgattaggagaatctcaaataggtaatacaaaatcaaaaggttgtaaaaggtctatagaaacaaggaagaggatgtcagaagccggaaaaaagccaaagaaaaagaaaacttgccatcattgtggtatgactggtggtgctggtaacatgactcgatatcattttgacaattgtaagaaaaaataaccttatgtaaaacttgacaaggcggtgtaggtcttgataggcttacatcacctttttattggtgaggtaactagatgaattacatggagattagaccatttgatacagctaatggtgaaggggttcgtgtaagcctcttcgtagctggttgtaagcatcactgtgaaggctgctttaacagggagtcttggaagtttaatgctggtaaagtatttacttatgcaaacctctacggaatcatccagctaatgggtgataatgctatcagtgggttgtcaatacttggtggagaacctctggatgatagaaatattcaggaggttaccaatatatgcaaacgtattaaaactatttatccagagaagtctatctggctctggacaggttttcagttacacgaaaaaattcacctagatgtgatgaaatatgttgacgtggtgattgatggtaagtatgattcatctaaaccaacagttaaaccatatcgtggttctgataaccaaaacctctggagaaaagagtatgggtggcaaggtgattgtcagtggagagccgagtaagtctcgtcgtagagtaggttacggaaaaggtgagataatggttctttcttttaacagtgctttattaggtacttacaaagttaagaccgaactccttgatgagtggagaaagtatacaaactcacttttcggtaatgttggaatggaagccttagcagagattgagaaggctggaacatttgaagttgtcggtaaaggtaactacacaatgttctacaaaacaaatttaaacgttggtgacagtattgttggtgtcactgaagaagaacttaaaacattttgtgaaaagattgagagagatacgaaatgggactctggaacagttttaaatcaaaagtaaaagcagcactagcttcattaggtatgctcactggtgttgatgtgactcatcttatgcagaactttaagatggatgagaagctggctaatgagattatgaaaagtatctatgtaggccgtggtaaaggtggtaagaaacaagcccatcgtccgtctggtgcagcagctattaaacgagcagctaagaaagctcgtaaccgtaaacgtaataagaaggctaaataatcatgagcaaaatctataacactcgcaaattacagattttcgtactgtgccagtttatggctaaagaatataacttctactattgtggtacaggttttattagtgatgatgatggttcatatctaccatttaaagaagctgtgaagctctttaatgaagagaaaaactctaagaaagatattgaaaaggttaagctaacctacagcaagaaagataagaagattatctgcctagataactttgtaaaagttactggagaagcaaaagagtttatggatgagagtgagatttcattcacaagcatcttgaaagtagctcagtaaacagatactataagggaactgtaaaggttccctttttattttggagataaaatgtatctgtcaaacctgaaacgttcggctgcaatgtcagtcctaagactcagctttgaggaacgtcaagagttcattgactcccaccaatacgacccttctaactcgaatcacatggttctttggaatcgtgataacttccgtgaaagagcacttgtccgttattacccacactacacaatagataacctgtatgaatggtgtgttgtgaagaacactattgcaacactgaacaatctttgcaggtatacaggtaagcaagcatttacattaggccaccacaaacctgttacaaagggtggtgagcatcactgtgcaaactggtttatccagactaagctcgataaccagaagcaaggagataaccttctaagcacacctaagatgacctatgaagagcaagagaaatatatcaaaaataatatgccagatgtgcttgacaacaactatacagatttggcaatatctctcctgttgaagttcgagacagtttatagggcaacttataatggctaaagagaagtggaagattttaccattagtcagtgaaggtggtaatggttgtgaaatgtacatgatacgtggtcatgttccagaaccaattgcacttgagatggtaaacaactttacagatggctcttacaaagacttaggggagccaactataaagcagcaatgggtaaagcctgtaccagacagcacaggtaactgtagtgtactttatcacgttgtagaccctgcaaaatgcaaatctgcaatggcagtaacaaacgtaacttttgattgagagagaaaactatgaaaacatctatccgtgttacagttcattcaccaactaaagggactcatgaagaagagtttaacatcgtccaatttccttctggtgagattggtggacatttttcaccagagtttgttgattttactgcttatgctgcatcatccatcaacaacgtgattatgattgtaaagggttatgacaaagacacattatttgctgtggcacttgctaaagaggcaattgatgatttagtacctcgtaagtttgctatgaagactgctatcttttactatttgccaaatgcacgttacgaccgtcacatgtttaaaggcgatgcagcagctttgaaagtgtttgcacaacaggttaatgcaatgggttttgatgcagtctgtgcagttgaccctcatagttacgttccagataaccttttcaactgcttccagagtattcctcaaaaggagattgcagtccactatgcaaatgaccctctgattgattacttagtagccccagatgcaggtgcttctaagaagattgcagagactgctaaagaggtggataaaccatatatcacaatgtctaaagtacgcaaccttaagactggtgaaataactggtatgcgaatccttgatgatgttgatttgacagataaaactgtcatgattcttgatgatatttgtgatggtggtcgaaccttcgtagaagcagcgaaacatcttcgtgaagcaggtgcaaaacgtgtggaactttatgtaacacatggtatcttctctaaagatgttgaaaaccttcttgacaatggtatcgaccatatttacactacaaactctttaggcgaagctaaagaccgtggcttaacacattacagtcaagttactgtagcaaaccttgattaggtaacagtatgaataagggttattttgaaagatacctaatatatgaaccagatacaggtttattaatttggagagtaaccctttgcagtaccgctattgctggtaatgtggctggcacaaggtctaagaagggttatatccaagtccagataaataagaagaggtactatgcacataatattgcatggattatgtctggaggtgagataccaagtggatatgagatagaccacatagaccttgataaatctaataataagttggagaatttaagacttagcacaaagtcacaaaatcagaggaataggggtatatacaagaataataaaactggtgtgaagggtgtaagtttttgtaaacaaacaggtctttacaaagcaagagtcatgctttaccataaagaatacttttgtggaagatttaaaacggtagaagaagcaaaagaagctgtaattaaaaagcgaatagaacttcatggtgagtttgcaagacataactaagagagagataaaatatgagtaagtcactttacgcagtaccagcaggtcttaatgcagatgcttacaaggcatcacatatatatcagtatccagatgctacgcaatatcttatgttgaacctgacaccacgtagtgataaatggtttaacagtcctttagcaattgacggtgtagtggcttttggtattcaacgttttgttaaagattacttgatagaccactggaacgccactttctttgaacgtgataaaaaagaagcaattgatgaaatcttagaagtcatgaatggtgttctgggtaaagatgctatcggtcgagagcattgggaagcacttcacgacttaggttatctaccagttgaagtatacgctgtagaagaaggcacagttgtccctatgcgtgttccaatgattgtcttccagaacactgtttcaggtttccattgggtagcaggttatctggaagatgctttctctgctgagatttggaaggcttgcaccattgcgactatcgcattgcactacaaacgtatctgtaagaagtgggctgaccttacttgcgacaacgacttacatttaccttatcagtgccatgactttgctatgcgtggtatgtccggctttactgatgacgcatttaatgctgtaggtcacttaaccagctttaaagggactgatagcttccctgctatatacacagctaaacgcatctatggacagtcttacccaatctctgatattggtagttctgtaccagccactgaacactctgtgatgtgtgcaaacattgcttgggaaggtggtaacgagttggttgaagaagaaagacgatttaaaggtgagttgcaaaccttccgtcgtttcttaacagaaacttacccaactggtattgcaagtattgtttcagatacttataacttctggagaactgtgtcagaaatcttaccagaacttcgtaaagaaattatggaacgtgatggcaagctggtaattcgccctgactctggagaccctgtacatattgtcacaggttataaagcaatccacttagagtgtgctaaaaaggcttactacgagcacctaagcaagctagaggcaagtgatacaatgctgaactctgtcctgaacatgaagcttgaaaacattagttacggtattgctggatggctactgtcagaaggctacgagatggttgttgacagagaagactttggagttgctgatacagtgatgttgaaaaatgcttatatggttggttctgcaaacgttgtaacacgtcctgtagctgaaattgatggagctattaagacactgtacaacatctttgggggaactattaactctaaaggatttaaggtacttgatgagcacatcggccttatctatggtgactctatcacgctggaacgtgcaaacgaaatcctgaagcgtctgtatgaaatgggttttgcaagctctaacgtagtgtttggtgtaggctcttacacttaccagtacatgactcgtgacacctttgcatttgctgtcaaagcaactcttgcaagcattggtggtaaagagattatgcttgcaaaagaccctaaaacagatagtggtgttaagaagtctgcctttggtggtgtagcacccatgtgggatggtgataagctgaaagctgtagatggctatggattccggagttttgcagatgtacttgaccacccagcttgtgctttacgtttagtctttagcgactctgagcagttcggttatacaactcttggtgatattcgaaacaatattgacaagcagctttaaaagtatatgataagaggctcctacgggagcctttttaatttctggagaaagacatgaaaatcaaagagatgaatattaacgttgtcttggaagaacgttgggaaaacattaagaaacctgaaaatggtcataaattccttaacaaaattttagtagcagctaaagaagaactgacgggtaaggttgcagcagcaatcacaataaaagtctgtgtaaaaggtcttccagacaaccaccaatttgcacttgacgagtttaaagaaagcttctacaatccaaacaaacagatacttgaaagtaactttgcagtgtctacaagtatcgtccatgacagaagctttatcctttacaaaaacatgagaggtgagtcatgcaagcatattggatagaaattttactgtcacttggtagtgtagcagtgtttgtctaccttctttgcaagtactatgcagagcacaagaagtgtgactactgtaacggagaagggtacacaagagcaggttgttgccctatttgtggtggttctggtaaaatgtttaataagtaatttaacagcaaactaagaggaaagtattatgcgcatggtaaacgaccacgcagaagtgattaagagttcaacttctttggagacatctcaagcacagattacaatgacacctgaaatgttcagccttttgagttctggtgtatatacctttaaagaaagggcagtgattcgtgaactgtcatgtaacgcagtagatgctcagaaagaagctggaaaagagaacatcccgttccatgtgcatttacctactcgttttgagccttactttgaagttcgtgatttcggaactggattgactcatgataaagttatgagtttgtacctaaactacggggcttctacgaagaatgactctaatgactacattggtgcaatgggtatcggctcaaagtcaccgtttgcaattgctcagtcattcacggtgtctagctatgttgatggtgttgttaataaatactctgtttaccttgagaatggtatccctcaagtgactaagcttactactaacccaacaaatgaacctaatggcttagctgtacgtgtggctgttgctgaccatcgcatttcaaagttctttgaagaggctggtaacgtatactcatactttgctgtaaaaccagaaagtaatattgtatatgatgatgtattagcagacatgaatgtcattgcccgtgaaaaaggtgtttatgatgctatgattcataagcaaagctggcgttctagtggcaacaggacagattttaatgtggtaatgggtaatattgcctacccagttaatatggaagcattacttggcgatgatttcttcaaagtcttgccagaatttttccgtaggagcgtagaccttgtaaacatctacatgcctattggctcagttgctattgcagcttctcgtgaagcattgcagatgaatgatacgacaaaaaatgttatcattgaggctaccaaaaagataactgaagcaattacaaaggatgttatcaagagagttaatagtcaacctacactcatggatgctgcacaggcttatgctgagttacgtttgaactcacgagagatgtttaatgctgtgtgtccaaaactagagtggggaggtgttaaacttgatactctggaagaagagttgctgaatattcgtcgtggaattatccatgcggaagacggctcagtcatctatgaacgtgacggcaaaggtaatattaaggttgacagcaaaggaaacaacatccccaaagttgactacctatacaatccagttgcttatgttaagtttaactctttagagagtaagattcgtgcaacagcactttcctacactcaagaagcaagcatgttcaatatctttggtgcaatgcgtaaaagtcaaattgaacagtttttgtttgttattaatgaccgtcgcaataaaaatggtactgagaagactgtaggccgcaatcagattctacgtggtgcatgtcgagactacgccagtgagtcaagtctgtttcacagatataatggtattgtatttgtattctcgactgaaaaagagttagatgatttaatcaatctgcacaaacttgataaaagcttgttaaagattgtgaaaatgtctgataaggaacaccattaccagcgcaaagaagctgtaaggggtgttgtaaaactctggaaagcagttccagcagaatctgtagcttcatacacagaggtgtcagaagacttagacacaattgaagaaccccagctttacattaaggcagtaggtgacacagttgatggcgaatgtttttgctcatctccagaagatgtagctaagtcagttgctaatgttatagggaagacagtctatgttttccgaaaagcaaattggaaaaagataccagaagactggattgaagtagatgagaagctcttgaacgacagcttaactgatgttcattggattaatcataacaggtatatgacacgcatctacatgaatggtgttcttgaccttacaagcagttggattattgccagaaactttacattcaataacaggaagatttctcgtggttattgctattcacgagatactagcaaaactatcttcctagagggtaacgaagaggctgtagaggcaattttcggtaaaatccagtatgttgctgcaccatttgcatacacttacactattagtgtgttgaagactttgaaagaatgtcttgacaatgatacaaagctttacaagaaaattaagaaagctggcgaccgcatggttattaagttggcaaactacctttcaaaaagaaaacaagaaaacttcttgctttcccatttagattggaataaagtgtcacctattgaagtgagtaagtttttgggctttaatgtgaaatgtgttccagaaggtacaacagtttacgattaaagtgcttgacaaggggctttgaagccccttagaatagcctcacaaaatgatttattaactaacaagagagagtaataagatgactactaaaactaaagcacagattgacgcagaaatttacaaactggttaaagagggcaagctgactaaaacagctattgcacagaaatttaacacctcaacccgttcagttggtcgtgctgtagagcgtcatgaagcaaccttaaaagggaataaaaaggtaacttctacaccagctacgaagactttaaagcaagttgctaagacctttaaaaagaaagctggaaaaccagttgaaaaggctgttaaagaggatgtacagaaagctccggtaaataagctgcatgaagctatgcagaatggcaaccagattgagtacatgattactggcgactctgttatcatgactttcggtgcagactctgaaatcgttgaatctacccatccgaactacaaagaaatcgtgatggctgttgtatccggtgagtataagaaagctttcgaactgatgaacattcgtaagtctatcgaaaacttcactcagggtgctatcaccatcaaaggtgacaagttattctatggtgctgttgagatgcgttctactctggttgaccgtattcttcacatgatggagactggagataaaggttttgaacgccttgtgatgttcttcgaaaaactgatggaaaacccatctaaagattctgtagaacaactttggggcttcgtatctcaccttgatgttgaaattgatgaagagggttacatcattggttggaagaaagtgtctactcgtgaaggcaagctggttgactcccgcacctgcaaagtacctaatgatttgggtaacattgtagaaatgccacgttggatggttgataataaccgtaacgtaacttgctctcaaggtcttcatgttggtgcttgggattatgttcgttgcttctcaggtgatacaatcctgaaggttcgtgtccatccacgagatgttgtatctgttccaactgattacaacgatatgaagatgcgttcgtctcgttatgaagttgcagcaatcgttgataatcaacgtaaagtactgaaagaatgggatggcaagactgaagctttgcatgtcatcgttggcactgctggagaacttatctcccaacgtaaacgtgaaatctaataagtaatttcttaaaaggctgcttcggcggccttttttatttgtattttgtgcagagtgctgtataattgttgtcacgataaactaaacaggagaaccaatgaagaaattgattctaggtttgtgcttaatgtttacagcacacttatcttatgcagttgactgcccagagctatcaattagccaaaaagtaaacatgttaaaagcttaccagtatggtgagaataacatgggtaaaggttggggtattactctagcagctatagccttacaagagtcagagttaggtctgaaggtagagaataaaaagacccatgactatggtattttccagaatcacttgaagactgtcgtaaagcgtaacaaaattagccctaatgtggctaaaaagaaactcttaagagactttgattatgctgcgaaggaaacgcacaaagagcttgagttttggacaaaggtacatggtcagccaaagtcaaagaagactttacaaaaagttttagcatcatataatgctgggtattcgtacagaatccctaaagctaagaaatattctcaagatgtttataacaatatgaaagtaattgctcaatgtgaatttgcaacaaacatttctaaggtaaaccatgaaaaaattaagaaagtctgatgaagtattgtgccatgcttatgacttacagcctcatgagttaggacttgattcctgtgtatggactccagaacagtgcagggattttgaagacaccgcaagagaagttgtatgctcacttgaagagttccacacatcagaaccaattgtgaacgttgtggacaaagagactgggcaatccataggtgtaaaacgtgatagcttagtcatagtcaacaaagaccttgtagagaaaggtaatcttatcttagcagatattgatggagttcttacaaattttaatcacgaagattgttcaacggaattgactgatggttcattttcacagtacactaatcttcttgattctgtaagagcaaaaccaacgtatgttttcaatatcattgatgcaattgctaatcatgctgccgttggactcttgacagcgagaggtgaatctcagagaatacccactgagatgtttttaaggcataacacggagcatgactacatgctttttatgcgtggttttgggactaactctataagtgcagaaagtttgaaagtgaggatgattcagtcttgcattctgccttactttaatatagtatgttttatagaagacacagagaagaatgtgcagaaggtgaacagaatccttccacacatcaaaaccatgttagttaaacattgagagaaaacttatgaacaatatcattacggtagcactggacgttacggcaaacaaatctgaagtagttcgtaacattatcaagagcaactttgagggtaaaatcttccgtgctgtcaatgtaaaagcagacggtaacattcgggagtatcgtgcccttttgaatgttaagaaacacgtcaaaggtgctggttcaacgactgcacacaaagaaaacctgatgaccatctatgatatggggatggcttcagaattaggtgctgaaggtatcgttaaagaaggtgctccgtatcgctctttcaatctggaaactgctctcatgctttcctttacaagtggttctaaaacaactacttatctctttactgatgctgcaacggtatctgctatcaaggatagcactgtcaaagctggggtagctgctgctgcaaaagcttcttcgatggctgcaaatgtccttgctaaagtcctcggttaaggttaagatacaggctccttcgggagcctttttcatttcaggagattgttaaatgacatttaaagagttctgtcaagctactttcataattgttttcttagttggggcaggtgtctggggaggatactcttacagagactatcaagttgctgaaactgagctaaacaatcaaaagctcataagtgttgctaaagatgcttatcaggaaggattagtcacactgagcaccaattacaaaaatgatttgaaagatgtgcttgctaagaataagcatacaaaagaggtactaacatatgaaaaaactaagccagagttttataatgtttgtgttactgataactatgtcagggtgttcaacgaacaaagtgaacagtacattcaaaaactcccaagtaagtgagagcgataagtacactcaagaagagtcacggtatatcatcaaaggcaacacaggcagtgatgtagcagcagcccttgagttctatcgtgacggcttttaccagtgtacaatcaaagctaataaccttattgatatgattttattagggaataagcagcaatgacagagaatgaagatactttttacgtagaagggtacttactgttgccacgaccaaaagaaacttatatgcgaattgatttcttaccaaccattatggataatgttatgtgtcatatctttatgcaaggtgtcacagcacagcttaagtatgttggtaaagagtgcaaaataaaggttgacactcatccagaaatcaaagagaatcactacacatggttcttaccagactctaaagaaatcttagcagttcttaaaacgaggaagtaactatgcagattaatggaagagaatttgtagccgtttactatgagaaaggtaaagaagttggcgtagcacaagtatcttatggcaatggtaagtggctatatggaacaatcgcagtagtaggaacaagaagtgatacaaaaacctttaaagattgtgttgaccttcttgaagaatccatccagaatcattggtgtctgatatggatgactgataacgaagtgatggagcgtttcaaaaagattggtgtcaacattgacagtattgagcatgttgatttatatgagctaactgagatggtaaactatgaaagctctagaggtaattgataaagacactggagaagttacatcagcatgtgttttcgttagtaacgacacagtgataccattttacaatctcgatagttttagttttacatggataactccagaagaatactttgaagaccttacctttgccagaatttctatagatacattctataaatgcttctatgatgaaggtaaagaattacgagaaactgaactataaggtatatattatatggctgacttctgcaaagactgttctatcgaaatgttcggacgtgatacaggtgacttaaaaggtcttatcactgaagatgactttaaagctggctatgcaatgccagtaatctgtgaaggctgtgggtgcatctgggtagaccacgaaggacaacgtgtaaagccttccgaagataaagaatcttgggagagatgttaaatgggtattgtaaaaattatcaaaggtgatatctttgacgcatttgataaaggtaagtttgatatcattggtcatggttgcaactgtatgaatttcatgggtgcaggtattgcagcaactatttctaagcgttatccaaaagtgtatgatactgacacagaagtttacctgtttgcaggtggcatccgtcacaaaccctgtgaaaatttactaggtaatttctctgtagtacgtttaaaacaaggccgtatagctaacctttacacccaacttcatactggtaaagatgcccgatacagtgctttagagtcatctttgaaacagcttaacagatactgtgaagtcaaccagttgaagaaggttggtctacctatgattggtgcaggtatcggtggacttgaccctcaagctgtcacagttatcatcaatcaggttatgaagagcgtagatgtttatctgtatgtctacgagacagagatgtacaacgagttacactcaggttggaaaaactactgtgaaccagaatactttgcaggtgtagttgtgttcacggacaatacagttaccctcttcagacgaagaaaaggtaagatacatcaaagtaaccctccggttgaaaagatgtctctaagtaacgctctagttacccacctgtcgaagagcaatcacaggattgcagtaacatttggtagtgatgcagacacttatatctatgcaagaactgatgaggatatcgagacagttttctcttcgccagaagttaccttcttagacgcaaagaactaagaaactctgtagagtattcacaatagactaagcctttcttatctggtaaatttttcaggtaaggagggcttttccatttcagaattgtgcaggtagagttctgtagagaaatctgtagagagaattctgaactccaaagagaaaattcattttcaaactgtgcagataatctccaaaggactttttcattttcaaaacgtgcagagaaaaatcaggtcgggcaagaaaaatcattttagaattgtgcaggtaggtgggtgtaggtggggctgtcgccatttctcacaaggctaccacatctgaaaataaaagtcaacagaaaaatttgtagcggattgaaaaataattcttgattatagttctgttttgtggtattcgcgcgcacccgtttcattacatttttgccaaaaatatttttaaaatttttcttgactattcgaacgggtttttatagtatttgcatcaacggggaggaaatgacttccccactaaataaaacccttaaactaggagaatctgaaaatggcatatcgtgcacctaaattcatcaataaaggcaatttccgcaatgcactggaaaaatcacttgatgagaattttacaggtcatattattgttgttcacgcatataattttaagtatgatattaacgggaataaaatcaaccattacacggcaaccatgttagatggtgcgctttcaagtgaaaaagccattctacatgcacttgcaggacgtggaaaaaacctgataagatgtgataagagacgttatcagggaggtgcatatggttgtgatgatgctatttaccatcttgaaaatatgggctattcagtagaaaaagttggagcgccgcaaatcattggtagtgatggttatgtaacaactttcaaaattagataataaagtactttacagggggcttatagttcaataaagtaagccccagataaagagctttaccactaaatcctaaattggagattcaaaaaatggctattatcaaaaacgttgtaattcctgcaaaaactcgtgatgacgctcgcatcatggcgaaaaagttaggcgggaaagtggttgacaatgggaaacaatctgctgtaaggtggggcgtgaaggttgataaacagttgaagttaaaaaattcaccaataaacctttttacatgtgtaaacactatcgggaagacaaatgtatacacgaaaaaggcatatattagacgcgtagccttaacatctcccattcgtacaatgagaagctatgcaaagctaaaaattaactgataaagtactttacagggggcttaaaagttgatatcttaagccccagataaagagctttaccactaaatcctaaattggagattcaaaatgaaaaatgtagacgctacctttgaagttgtaaaagaaaaattttccatcatctacgaagcggtaaattgctatgaagcaagccataatcttgataattggaagtttacagatgaccatcaaggcggcgtgactgttaaaaatcctaactgtcagtataatgaatttaaatatgcaatccctttgcattacagccttaaacagctttcaagtgactatgcaaaacaaggccgggaaaatccatcaaaagatgcttacattagcttacagaaagaattagaaagagatttagaggcttcagaatacgaccttgccgcgaaagttgtcgatgcaaatggcaacacggttttagagagtttttatctaggatatgcctttgactggtgctatagtgacggtgatgatttagaggaaagactaaaagaagaggtgagcaattcagacgcagaaactgaagtattagaacgtttggaatcattaaaagactcagtgatgaatatctttaagaactaaagagatttctttacacggggttatcaagctgataagatagccccagataaagagatttatcaactgtcctaaactggagattcaaaatgaaattatcaaataaagttcgtgaaaatctaagcaagttactaaacaaaattgatttcattgaaacatcaaggaataatcatgatgttatggaatggttacatggaaaaataaaaggccgtcgtgtagtgatttgcttatggaatagttgcagggagtataaaaaacctgtattgcaagtcaatatttatgatgacacttttaaaagtccagtaaagtctaaaagcgatttattagaatcctatgagataactgtaaatggcaaagtatcacgtaaagaggaaacaccatgttaatgactggtatcactgcaatcattgccattttcgcgctatataaggcatataaagcctataatctagcaaataaggcaatcacacagcaggttagcaatagcctcgtagagagctttctagagcgcctcagtgatgagcaaataaagcggctagagatgagcttcagatataaagcgaaaacctatcagataagtgacatcttcaaagatgattttcagttagtcgatgattataattcactgataaatgctttaaatatcagtggcttaaaagactactacgctgtaattgttcaagaattgagcaaacgaaaacaaagtgtttgacactggtttttagatagattaaattacacatcaacggggagggaatgaccttcccactaaataaagtccttaaactaggagactcgaaaatgtatactactaacaacggtcgtactctaaacgtaactttacggcactatgtagacggtgtaatgcactttgaggatttacgggctgaacaacatatcttagattggcaagtagcaggactccaaaaaactgctacgggatacggtaaaaagattccaaccagttggaaggtacactatgaaggacgtctgcgcagaatttatcaagatgtgtgtagtaatagcgcatcaagttacatcatagtaaaaggtaaaaaactgcacttagtataaagtgctttacatggggcttaaaagtctgtaaagtaagccccagataaagagctttaccactaaatcctaaattggagaacttaaaaatggctattaataaccgtgaattagcaatcttaaaagcacgtttgaccgttaaccggattaatgttattacgtcatcagcaccggatgaaacattgcataacattattgggaagattcaaagtgttatcttagacgttgaaaatgtaaaaagttcattggctgacgttgcagcaggtatcacgctagacggcgcacaatatgaaatgtccgacatgttaggcaaatcaaaggtaatgaataaagaattagacttgaaaatgtttcgatttgctgtcaaagtgtggctatctgtcgagtatgacgctaattttgcaatcgctgatttctttgccacttggttacaacgtaatttgacaaatcacgattttcgtggtatctgcgatgcaatttatgcagaactctaaaaaattttgttgacactggtttttagatagattaaattacacatcaacggggagggaatgaccttccccactaagtaaagtcctaaactggagattctaaaaatggctattatcaacggcttacacattgaaacaactcacatcaaagatattaaagttggtgatgtagtcctttcccacggcgtagagaaaactgtcactgcaaaggatatcaaagaggattctttcatgggtaggactctcttcggtgattcttattgcttaggttatcttgcagttttaaaagttgtcaaaaataacaaataaagtactttacagggggcttggaagttgatatcttaagccccagataaagagctttatcactcaatccttaaactaggagattcaaaaatgaaatgctatcacggaactactatgaaaaactttgtaaacctgcttaaaggtggcgacaagccggaaggtatctggaactgctcttacatggatgattgtttttacgtttacccgatggataagattatcaagatggaatgcctggaagatgaagaagcctcttacatccgtgaacgctgcattcaaaacgctttagagtcggggcttattacggcagctttccaaatggaaacgcaggaagtgattgtaattgaaatggatatcccagaggaagaacttgaggacgattattcttgtgacaacatgagcgaaatcgccagctttaccggttactttgataaagattggattatcggtattcactcgacgaaatttagtgcgatgtatgcgccattctttgtacctgatacaactaaccgcaatttgggctatattgacgatgatttgttgagtattgcaaaaattgtacagaatagcggggacacttcttctgtgttttgtgacctgctggataaaattaccgagaatctcacagagcgcaatctaagcgactttttagactaagcagtacaaagacactaatttccaacttaaggcccatacagggccatttagagggcttaaatcatgcttacaaccgtttaccttatcctttctatttgcaatggccattcatgtgattttaaagggcttgaggagttcacaggaagtaaagaaaatgctattcaagtttgccagatagcaaggcaagactatcccgcaagtgatgatattcagtgttactttaagacagaagatgacgacggaatctatttcgacagtgttgatggtcaatatgaaattatcattgaaaaagactagacaagcctgataaaagtctgtaaattgtcaatcaacggggagggaatgaccttccccactaagtaaagtccttaaactaggagattctaaaaatggcttatgtaaccgtaattactgataaagctggcgcatcttggtcaactcaagtaagtgataagatgtcacctatgcagtgcctaaaatactttgaacagtggaacaaaggtgaggatacaagcccctttcaagtgatgcaggttatccatgtagataacgaagggaataaaacgaccttaaatagcgagtactacgcaagccgttttgaaacgaggagtaagacaatgaagctcttacgtgaatccggttactctcatattgccgctctaatctgggatgacctgctaaaaagtcaacgtatcagctacgtaaagcctgaaaaaatctttataagctaatcaacaacttacaaaaaactttcaaaaattacttgacgataccccttgacaatagtacatttgttcgagggggttttatctaaaagggattcacttaaaagattctttatagataagactaaaaagggcttgcaatcactttctaaaagccctatagtatcaatcaagcaatcaagcttacttcctaaactggagattcaaaatgaacaagttcaccgctattaatactatccgctcaaaagatgtaatgaaaaaacctgttaaggatacctttgagtttaccctgaaagaaaagacttttgcagtcatcacgaaaggggaagataaaaagtattacatccatcgcccaaatcagaaaatggtaaccgctaacaactttatgaaagctgttgcaatgattttaacggattatatggctatcgtcgcagagattcacgaaatggctatcaaggccactaaaaacgagttaaaccgctataaaatggcatatgagcgttctatcaagtctcataatctttttattgcaatccattataccgggatgtatgctatggggacgggtaaccaacaatacccgctctatgatgttgaaaatatctttacaagtgattatccgacaactaaattcaaaataacgttaggcgaggcattgagtagagcaattcggctttatgagcaatctctaaaaaacttagaaaattcacttgatgaaacactagtgagtctttaaagtatctaacaaggggagggaatgacctccccaacaatcctaaactggagacttgaaaaatgaattttgaacagcgtatgattacaaaatttggtgctaaacgttgggaagaaatgaaaaaagagcatgaagaaaagaaaaatgaagaaatggtcgtcatcactggtacagatttattaaaccactcagttactaattacatcatttctggcaactcttacaagaaagttatttgattaacaagacgccgcaacggggcaaatagccccagatacctttacagcccctagaaaggggcttttacgtctatacaaccccttactagaatcttaccagacatttagagtaataactctatagtttactctataccatcttatcaaatcaactaatcttccccttaaatataagcccataacccgaaagggaagggcaatccctaaaacgctctataacgctctataacggcttatcatctcaacttaagcaatcatattaaaccactcttaaaaaccctttatagagcttcctacagccttaaaagaatcttataagggtataagcttataagctggctagtatcttgtgaatatctaaacagggctacaaagtcacttaaaagttacgtcagagatagcttaaaagttacgtaaaaagagctataaagttacgtaaaaagagctataaagttacgtaaaaagagctataaagttacgtaaaaagagctataaagttacgtaaatgctagcccccttaacattttcttaa

The invention claimed is:

1. Composition of bacteriophages for the prevention, elimination and/or reduction of infections and contaminations caused by *Salmonella enteritidis, Salmonella typhimurium* and *Salmonella paratyphi* B, comprising phages and excipients, between 2 and 6 phages selected from the group consisting of φSan13 of SEQ ID NO: 1, φSan14 of SEQ ID NO: 2, φSan15 of SEQ ID NO: 3, φSan23 of SEQ ID NOs: 4 and 5, φSan24 of SEQ ID NO: 6, and φSan25 of SEQ ID NO: 7.

2. Composition of phages according to claim 1, wherein the composition comprises between 3 and 6 phages selected from the group consisting of φSan13 (SEQ ID NO: 1), φSan14 (SEQ ID NO: 2), φSan15 (SEQ ID NO: 3), φSan23 (SEQ ID Nos: 4 and 5), φSan24 (SEQ ID NO: 6), and φSan25 (SEQ ID NO: 7).

3. Composition of phages according to claim 1, wherein the composition comprises between 4 and 6 phages selected from the group consisting of φSan13 (SEQ ID NO: 1), φSan14 (SEQ ID NO: 2), φSan15 (SEQ ID NO: 3), φSan23 (SEQ ID Nos: 4 and 5), φSan24 (SEQ ID NO: 6), and φSan25 (SEQ ID NO: 7).

4. Composition of phages according to claim 1, wherein the composition comprises 6 phages selected from the group consisting of φSan13 (SEQ ID NO: 1), φSan14 (SEQ ID NO: 2), φSan15 (SEQ ID NO: 3), φSan23 (SEQ ID Nos: 4 and 5), φSan24 (SEQ ID NO: 6), and φSan25 (SEQ ID NO: 7).

5. Composition of phages according to claim 1, wherein the composition comprises additional phages belonging to the order Caudovirales.

6. Composition of phages according to claim 1, wherein the composition comprises only phages selected from the group consisting of φSan13 (SEQ ID NO: 1), φSan14 (SEQ ID NO: 2), φSan15 (SEQ ID NO: 3), φSan23 (SEQ ID Nos: 4 and 5), φSan24 (SEQ ID NO: 6), and φSan25 (SEQ ID NO: 7).

7. Composition of phages according to claim 1, wherein the size of the genomes of the phages varies between 30 and 180 kb.

8. Composition of phages according to claim 1, wherein each of the phages is in equal proportion.

9. Composition of phages according to claim 1, wherein each genome of the phages is free from toxicity and virulence genes.

10. Composition of phages according to claim 1, wherein the efficiency in vitro of the cocktail of bacteriophages decreases the bacterial population of *Salmonella* between 3.33 and 4.62 log 10 CFU/ml during 10 hours of exposure to the cocktail.

11. Composition of bacteriophages according to claim 1, wherein the phages that make up the composition infect a minimum of 50% of the strains evaluated with an efficiency of plating (EOP) greater than or equal to 1.

12. Composition of bacteriophages according to claim 1, wherein the excipient is selected from a solvent or a buffer.

13. Composition of bacteriophages according to claim 1, wherein the composition is administered in liquid, spray or solid form.

14. Composition of bacteriophages according to claim 1, wherein the composition comprises a composition of bacteriophages selected from the group consisting of φSan13 (SEQ ID NO: 1), φSan14 (SEQ ID NO: 2), φSan15 (SEQ ID NO: 3), φSan23 (SEQ ID NOs: 4 and 5), φSan24 (SEQ ID NO: 6), and φSan25 (SEQ ID NO: 7), in a dose of $10^7$-$10^9$ PFU/mL.

15. A method for controlling *Salmonella enteritidis, Salmonella typhimurium* and *Salmonella paratyphi* from surfaces, plant, equipment and machinery present in farms for animals comprising applying the composition of bacteriophages according to claim 1.

16. A method for controlling or eliminating *Salmonella enteritidis, Salmonella typhimurium* and *Salmonella paratyphi* B in farm animals, poultry comprising administering the composition of bacteriophages according to claim 1.

17. A method for controlling or eliminating *Salmonella enteritidis, Salmonella typhimurium* and *Salmonella paratyphi* B in eggs, processed foods and the packaging thereof comprising applying the composition of bacteriophages according to claim 1.

18. A liquid or solid feed supplement and disinfectant comprising the composition of bacteriophages according to claim 1.

19. A feed supplement that comprises a composition of bacteriophages that comprises between two and six bacteriophages selected from the group consisting of φSan13 (SEQ ID NO: 1), φSan14 (SEQ ID NO: 2), φSan15 (SEQ ID NO: 3), φSan23 (SEQ ID Nos: 4 and 5), φSan24 (SEQ ID NO: 6), and φSan25 (SEQ ID NO: 7).

20. A disinfectant that comprises a composition of bacteriophages that comprises between two and six bacteriophages selected from the group consisting of φSan13 (SEQ ID NO: 1), φSan14 (SEQ ID NO: 2), φSan15 (SEQ ID NO: 3), φSan23 (SEQ ID Nos: 4 and 5), φSan24 (SEQ ID NO: 6), and φSan25 (SEQ ID NO: 7).

* * * * *